United States Patent
Ertl et al.

(10) Patent No.: US 10,953,108 B2
(45) Date of Patent: Mar. 23, 2021

(54) COMPOSITIONS AND METHODS OF REPLICATION DEFICIENT ADENOVIRAL VECTORS FOR VACCINE APPLICATIONS

(71) Applicant: THE WISTAR INSTITUTE OF ANATOMY AND BIOLOGY, Philadelphia, PA (US)

(72) Inventors: Hildegund C. J. Ertl, Philadelphia, PA (US); Xiang Yang Zhou, North Wales, PA (US)

(73) Assignee: The Wistar Institute of Anatomy and Biology, Philadelphia, PA (US)

( * ) Notice: Subject to any disclaimer, the term of this patent is extended or adjusted under 35 U.S.C. 154(b) by 0 days.

(21) Appl. No.: 16/322,139

(22) PCT Filed: Jul. 21, 2017

(86) PCT No.: PCT/US2017/043315
§ 371 (c)(1),
(2) Date: Jan. 31, 2019

(87) PCT Pub. No.: WO2018/026547
PCT Pub. Date: Feb. 8, 2018

(65) Prior Publication Data
US 2019/0167813 A1    Jun. 6, 2019

Related U.S. Application Data

(60) Provisional application No. 62/369,288, filed on Aug. 1, 2016.

(51) Int. Cl.
| | |
|---|---|
| C12N 15/861 | (2006.01) |
| C12N 15/86 | (2006.01) |
| A61K 39/00 | (2006.01) |
| A61K 39/015 | (2006.01) |
| A61K 48/00 | (2006.01) |
| C07K 14/005 | (2006.01) |
| A61K 39/12 | (2006.01) |
| A61P 31/18 | (2006.01) |
| A61K 39/39 | (2006.01) |

(52) U.S. Cl.
CPC .......... *A61K 48/0058* (2013.01); *A61K 39/12* (2013.01); *A61K 39/39* (2013.01); *A61K 48/0008* (2013.01); *A61K 48/0091* (2013.01); *A61P 31/18* (2018.01); *C07K 14/005* (2013.01); *C12N 15/86* (2013.01); *A61K 2039/525* (2013.01); *A61K 2039/5256* (2013.01); *C12N 2710/10343* (2013.01); *C12N 2740/16234* (2013.01)

(58) Field of Classification Search
CPC ...... A61K 2039/5256; A61K 2039/525; C12N 15/86; C12N 2710/10343; C12N 7/00
See application file for complete search history.

(56) References Cited

U.S. PATENT DOCUMENTS

| | | | |
|---|---|---|---|
| 5,814,486 A | 9/1998 | Cohen et al. | |
| 6,936,255 B1 | 8/2005 | Wettendorff et al. | |
| 8,962,816 B2 | 2/2015 | Ertl et al. | |
| 9,624,510 B2 | 4/2017 | Ertl et al. | |
| 9,724,406 B2 | 8/2017 | Ertl et al. | |
| 2004/0253210 A1 | 12/2004 | Robert-Guroff et al. | |
| 2005/0095270 A1 | 5/2005 | Staecker et al. | |
| 2013/0315871 A1 | 11/2013 | Roy et al. | |
| 2014/0065105 A1* | 3/2014 | Wilson ................. | C07K 14/005 424/93.2 |

FOREIGN PATENT DOCUMENTS

| | | |
|---|---|---|
| EP | 1336619 A2 | 8/2003 |
| WO | 2006120034 A1 | 11/2006 |
| WO | 2007071997 A2 | 6/2007 |

OTHER PUBLICATIONS

International Search Report and Written Opinion, PCT/US17/43315, dated Nov. 30, 2017.
Cervasi, et al., "Immunological and Virological Analyses of Rhesus Macaques Immunized with Chimpanzee Adenoviruses Expressing the Simian Immunodeficiency Virus Gag/Tat Fusion Protein and Challenged Intrarectally with Repeated Low Doses of SiVmac," Journal of Virology, 87(17), Sep. 2013, 9420-9430.
Lasaro, et al., "Vaccine-induced T cells Provide Partial Protection Against High-dose Rectal SIVmac239 Challenge of Rhesus Macaques," Molecular Therapy, 19(2), Feb. 2011, 417-426.
Lewis, et al., "Response of a simian immunodeficiency virus (SIVmac251) to raltegravir: a basis for a new treatment for simian AIDS and an animal model for studying lentiviral persistence during antiretroviral therapy," Retrovirology, 7(21), 2010, 1-19.
McCoy, et al., "Effect of Preexisting Immunity to Adenovirus Human Serotype 5 Antigens on the Immune Responses of Nonhuman Primates to Vaccine Regimens Based on Human- or Chimpanzee-Derived Adenovirus Vectors," Journal of Virology, 81(12), Jun. 2007, 6594-6604.

(Continued)

*Primary Examiner* — Barry A Chestnut
(74) *Attorney, Agent, or Firm* — Saul Ewing Arnstein & Lehr LLP; Kathryn Doyle

(57) ABSTRACT

The invention includes compositions and methods of generating a chimpanzee-derived adenovirus AdC6 or AdC7 vector vaccine comprising a deletion of E1, a deletion of E3 ORF3, ORF4, ORF5, ORF6, and ORF7 and a sequence encoding HIV protein gp140, gp160 or Gag, methods of treating and/or preventing or immunizing against HIV and methods of inducing an effector T cell, memory T cell and B cell immune response in a mammal administered the composition produced thereby. Furthermore, the invention encompasses a pharmaceutical composition for vaccinating a mammal as well as a protein expression system.

30 Claims, 117 Drawing Sheets
Specification includes a Sequence Listing.

(56) References Cited

OTHER PUBLICATIONS

Patel, et al., "DNA and virus particle vaccination protects against acquisition and confers control of viremia upon heterologous simian immunodeficiency virus challenge," PNAS, 110(8), Feb. 2013, 2975-2980.
Santra, et al., "Heterologous Prime/Boost Immunizations of Rhesus Monkeys Using Chimpanzee Adenovirus Vectors," Vaccine, 27(42), Sep. 2009, 5837-5845.
Small, et al., "Viruses—From Pathogens to Vaccine Carriers," Curr. Opin, Virol., 1(4), Oct. 2011, 241-245.
Tatsis, et al., "Adenovirus Vector-Induced Immune Responses in Nonhuman Primates: Responses to Prime Boost Regimens," Journal of Immunology, 182, 2009, 6587-6599.
Tatsis, et al., "Multiple Immunizations with Adenovirus and MVA vectors improve CD8+ T cell functionality and mucosal homing," Virology, 367(1), Oct. 2007, 156-167.
Zhou, et al., "A Universal Influenza A Vaccine Based on Adenovirus Expressing Matrix-2 Ectodomain and Nucleoprotein Protects Mice From Lethal Challenge," Molecular Therapy, 18(12), Dec. 2010, 2162-2169.
Zhou, et al., "An efficient method of directly cloning chimpanzee adenovirus as a vaccine vector," Nat. Protoc., 5(11), Nov. 2010, 1775-1785.
Zolla-Pazner, et al., "Analysis of V2 Antibody Responses Induced in Vaccinees in the ALVAC/AIDSVAX HIV-1 Vaccine Efficacy Trial," PLOS One, 8(1), Jan. 2013, 1-11.
European Search Report, EP17837398, dated Apr. 20, 2020.
Singapore Search Report, SG Application No. 11201900808S, dated Apr. 29, 2020.
Altstein, et al., "Immunization with influenza A NP-Expressing Vaccinia Virus Recombinant Protects Mice Against Experimental Infection with Hyuman and Avian Influenza Viruses", Archives of Virology, vol. 151, No. 5, May 2006, pp. 921-931.
Alves, et al., "Antibody Response in Mice Immunized with a Plasmid DNA Encoding the Colonization Factor Antigen I of Enterotoxigenic *Escherichia coli*", FEMS Immunology Medical Microbiology, vol. 23, No. 4, Apr. 1999, pp. 321-330.
Bayer, et al., "Improved vaccine protection against retrovirus infection after co-administration of adenoviral vectors encoding viral antigens and type I interferon subtypes", 2011 Retrovirology 8:75 (15 pages).
Casimiro, et al., "Attenuation of simian immunodeficiency virus SIVmac239 infection by prophylactic immunization with DNA and recombinant adenoviral vaccine vectors expressing Gag", 2005, J Virol 79(24):15547-15555.
Casimiro, et al., "Comparative Immunogenicity in Rhesus Monkeys of DNA Plasmid, Recombinant Vaccinia Virus, and Replication-Defective Adenovirus Vectors Expressing a Human Immunodeficiency Virus Type 1 gag Gene", 2003, J Virol 77(11):6305-5313.
Chawla, et al., "Adenovirus-vectored vaccines", Dev Biol Stand, Mar. 16, 2008, vol. 18, No. 3, pp. 293-307, 1 Table.
Chen, et al., "Adenovirus-Based Vaccines: Comparison of Vectors from Three Species of Adenoviridae", 2010, Journal of Virology 84(20):10522-32.
Chen, et al., "Direct Observation of Xe and Kr Adsorption in a Xe-Selective Microporous Metal-Organic Framework", J. Am. Chem. Soc. 2015, 137, 7007-7010.

Engram, et al., "Vaccine-induced, simian immunodeficiency virus-specific CD8+ T cells reduce virus replication but do not protect from simian immunodeficiency virus disease progression", 2009, J Immunol 183:706-717.
Hazama, et al., "Adjuvant-independent enhanced immune responses to recombinant Herpes Simplex Virust Type 1 Glycoprotein D by fusion biologically active interlukin-2", Vaccine, vol. 11, No. 6, 1993, pp. 629-636 (Abstract only).
He, et al., "A simplified system for generating recombinant adenoviruses", 1998, PNAS 95:2509-14.
Hinuma, et al., "A novel strategy for converting recombinant viral protein into high immunogeic antigen", FEBS Letters, vol. 288, No. 1/2, Aug. 1991, pp. 138-142 (Abstract only).
Horwitz, "Function of adenovirus E3 proteins and their interactions with immunoregulatory cell proteins", 2004, J Gene Med 6:S172-S183 (Abstract only).
Lasaro, et al., "Antibody-inducing properties of a prototype bivalent Herpes Simplex virus/Enterotoxigenic *Escherichia coli* DNA Vaccine", FEMS Immunology and Medical Microbiology, vol. 35, No. 1, Jan. 21, 2003, pp. 25-31.
Lasaro, et al., "Anti-Tumor DNA Vaccines based on the Expressiopn of Human Papillomavirus-16 E6/E7 Oncoproteins Genetically Fused With the Glycoprotein D from Herpes Simplex Virus-1", Microbes and Infection, vol. 7, No. 15, Dec. 2005, pp. 1541-1550 (Abstract only).
Lasaro, et al., "Human papillomavirus-associated cervical cancer: Prophylactic and therapeutic vaccines", Gene Therapy Molecular Biology, 2004, vol. 8, pp. 291-306.
Lasaro, et al., "New insights on adenovirus as vaccine vectors", Molecular Therapy, vol. 17, No. 8, Aug. 1, 2009, pp. 1333-1339.
Lichtenstein, et al., "Functions and mechanisms of action of the adenovirus E3 proteins", 2004, International Reviews of Immunology 23:75-111.
Michel, et al., "Enhanced Immunogenicity of HPV 16 E7 Fusion Proteins in DNA Vaccination", Virology, 2002, vol. 294, pp. 47-59.
Plonka, et al., "Light Hydrocarbon Adsorption Mechanisms in Two Calcium-Based Microporous Metal Organic Frameworks", Chem. Mater. 2016, 28, 1636-1646 (Abstract only).
Saha, et al., "A Fused Gene of Nucleoprotein (NP) and Herpes Simplex Virus Genes (VP22) Induces Highly Protective Immunity Against Different Subtypes of Influenza Virus", Virology, vol. 354, No. 1, Oct. 10, 2006, pp. 48-57.
Shiver, et al., "Replication-incompetent adenoviral vaccine vector elicits effective anti-immunodeficiency-virus immunity", 2002, Nature 415:331-335.
Tatsis, et al., "Chimpanzee-origin adenovirus vectors as vaccine", 2006, Gene Therapy 13:421-429.
Watson, et al., "Herpes Simplex Virus Type=1 Glycoprotein D Gene: Nucleotide Sequence and Expression in *Escherichia coli*", Science, vol. 218, Oct. 22, 1982, pp. 381-384 (Abstract only).
Xiang, "Chimpanzee Adenovirus Antibodies in Humans, Sub-Saharan Africa", 2006, Emerging Infectious Diseases 12 (10):1596-1599.
Zago, et al., "Use of herpes simplex virus and pseudorabies virus chimeric glycoprotein D molecules to identify regions critical for membrane fusion", PNAS, 2004, vol. 101, No. 50, pp. 17498-17503.

\* cited by examiner

| Group/Vaccine | NHP ID | Genotype | Gender | AdHu5 Titer | AdHu26 Titer |
|---|---|---|---|---|---|
| 1 AdC7/C6 | 4825 | -* | M | 20 | 640 |
| | 4826 | - | M | 20 | 640 |
| | 4889 | - | M | 0 | >1280 |
| | 4372 | A01, A02 | F | 20 | 1280 |
| | 4395 | A01, A02 | M | 0 | 320 |
| | 4400 | A01 | M | 160 | 640 |
| | 4552 | A01 | M | 20 | 160 |
| | 4553 | A01 | M | 40 | >1280 |
| | 4770 | A01 | M | 40 | 10 |
| | 4773 | A01 | M | 80 | 40 |
| | 4774 | A01 | M | 160 | 20 |
| | 4894 | A02, B17 | M | 0 | 160 |
| 2 AdHu26/Hu5 | 4389 | A02 | F | 0 | 160 |
| | 4892 | A02 | M | 0 | 1280 |
| | 4893 | B01 | M | 20 | 80 |
| | 4916 | - | M | 40 | >1280 |
| | 4381 | A01, A02 | M | 40 | 1280 |
| | 4394 | A01 | M | 20 | 1280 |
| | 4547 | A01 | M | 160 | 1280 |
| | 4776 | A01 | F | 40 | 20 |
| | 4777 | A01 | M | 160 | 40 |
| | 4778 | A01 | M | 80 | 80 |
| | 4779 | A01 | M | 20 | 640 |
| | 4781 | A01 | M | 10 | 320 |
| 3 None | 4824 | - | M | 0 | 160 |
| | 4886 | - | M | 0 | 0 |
| | 4891 | - | M | 0 | 20 |
| | 4365 | A01 | F | 10 | 1280 |
| | 4398 | A01, B01 | F | 10 | 0 |
| | 4546 | A01 | M | 80 | 640 |
| | 4769 | A01 | M | 80 | 20 |
| | 4771 | A01 | M | 40 | 1280 |
| | 4772 | A01 | F | 160 | 80 |
| | 4775 | A01 | M | 640 | 40 |
| | 4780 | A01 | M | 20 | 160 |
| | 4392 | A02, B17 | F | 40 | 0 |

* animals were not positive for A01, A02, B01 or B17

Fig. 3

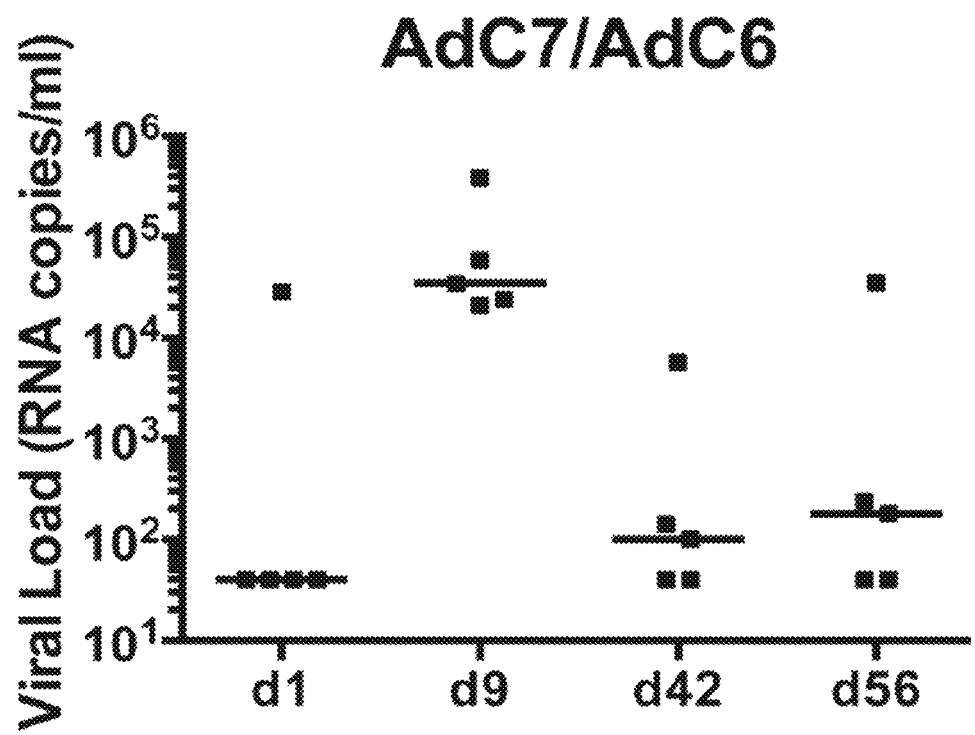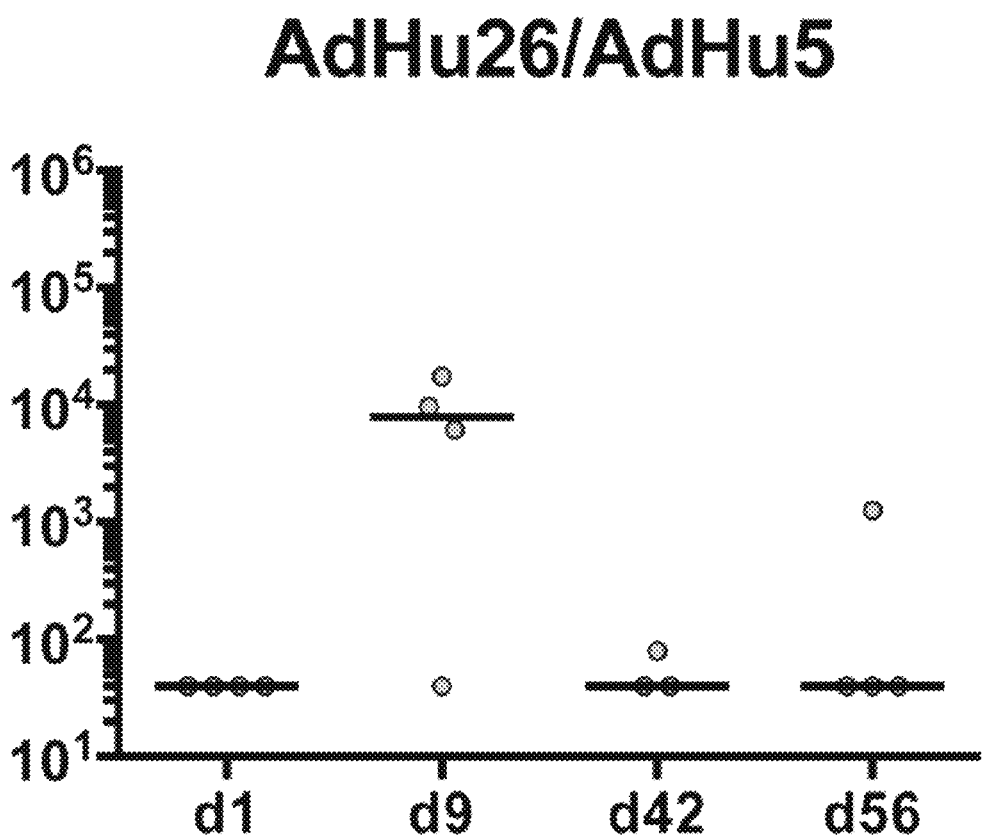
Fig. 8

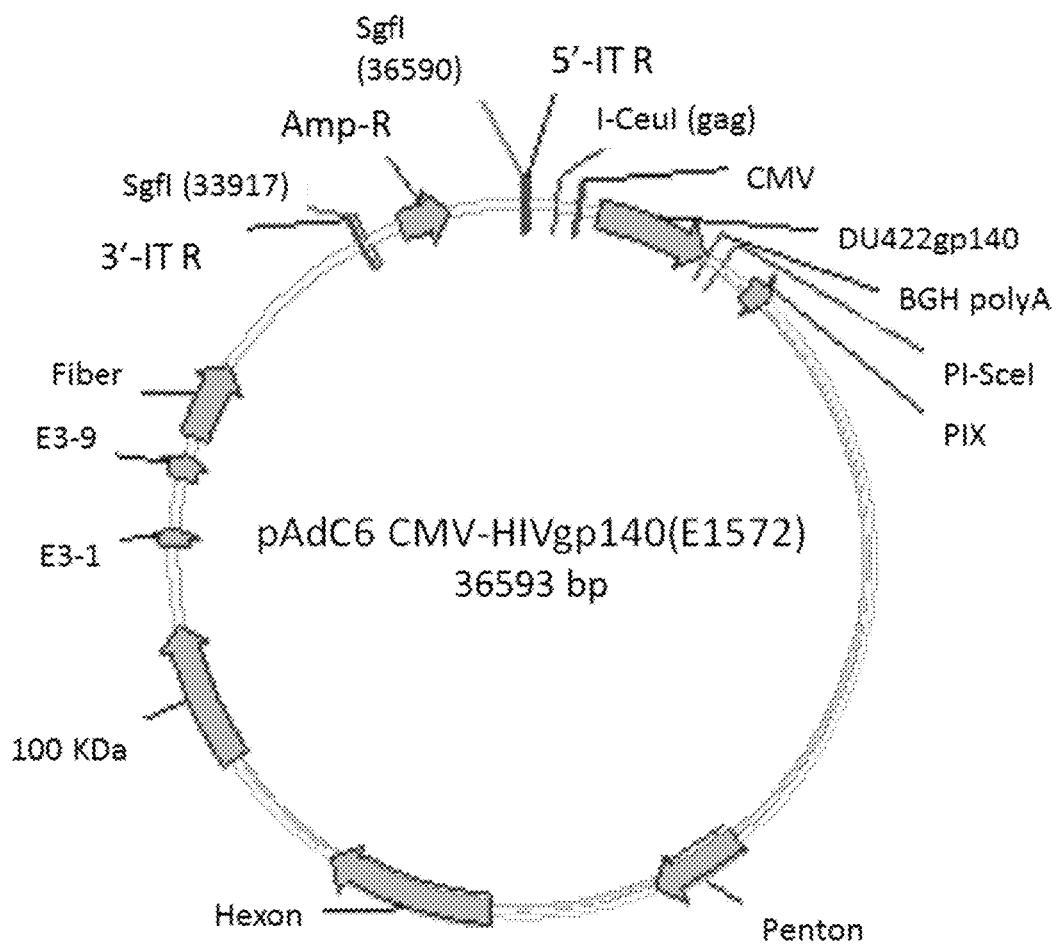
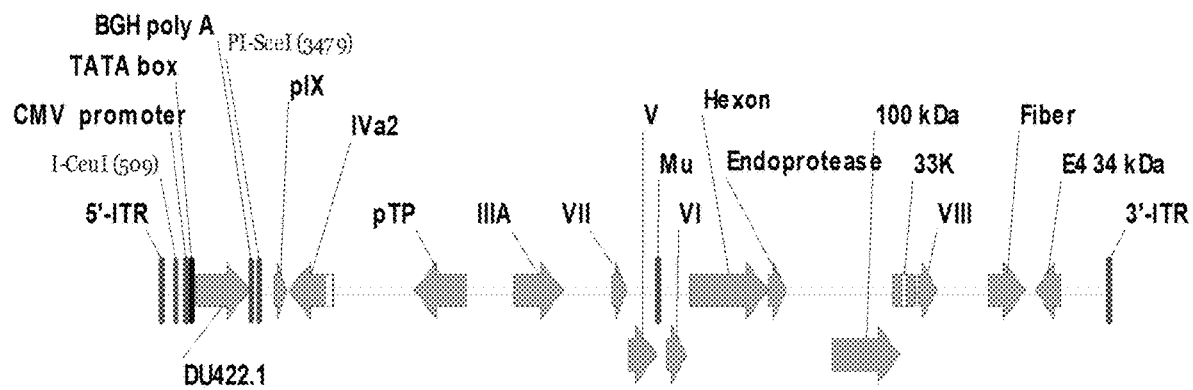
Fig. 19A

Fig. 20A

AdC6 020-HIVgp140(E1572) Nucleic Acids - SEQ ID NO: 1

```
CATCATCAATAATATACCTCAAACTTTTGGTGCGCGTTAATATGCAAATGAGCTGTTTGAATTTGGGGAGGGAGGAAGGTGAT
TGGCTGCGGGAGCGGCGACCGTTAGGGGCGGGGCGGGTGACGTTTTGATGACGTGGCTATGAGGCGGAGCCGGTTTGCAAG
TTCTCGTGGGAAAAGTGACGTCAAACGAGGTGTGGTTTGAACACGGAAATACTCAATTTTCCCGCGCTCTCTGACAGGAAATG
AGGTGTTTCTGGGCGGATGCAAGTGAAAACGGGCCATTTTCGCGCGAAAACTGAATGAGGAAGTGAAAATCTGAGTAATTTC
GCGTTTATGGCAGGGAGGAGTATTTGCCGAGGGCCGAGTAGACTTTGACCGATTACGTGGGGGTTTCGATTACCGTATTTTTC
ACCTAAATTTCCGCGTACGGTGTCAAAGTCCGGTGTTTTTACGTACGATATCATTTCCCCGAAAGTGCCACCTGACCGTAACTAT
AACGGTCCTAAGGTAGCGAAAGCTCAGATCTCCCGATCCCCTATGGTGCACTCTCAGTACAATCTGCTCTGATGCCGCATAGTT
AAGCCAGTATCTGCTCCCTGCTTGTGTGTTGGAGGTCGCTGAGTAGTGCGCGAGCAAAATTTAAGCTACAACAAGGCAAGGCT
TGACCGACAATTGCATGAAGAATCTGCTTAGGGTTAGGCGTTTTGCGCTGCTTCGCGATGTACGGGCCAGATATACGCGTTGA
CATTGATTATTGACTAGTATGCCAAGTACGCCCCTATTGACGTCAATGACGGTAAATGGCCCGCCTGGCATTATGCCCAGTAC
ATGACCTTATGGGACTTTCCTACTTGGCAGTACATCTACGTATTAGTCATCGCTATTACCATGGTGATGCGGTTTTGGCAGTACA
TCAATGGGCGTGGATAGCGGTTTGACTCACGGGGATTTCCAAGTCTCCACCCCATTGACGTCAATGGGAGTTTGTTTTGGCACC
AAAATCAACGGGACTTTCCAAAATGTCGTAACAACTCCGCCCCATTGACGCAAATGGGCGGTAGGCGTGTACGGTGGGAGGT
CTATATAAGCAGAGCTCGTTTAGTGAACCGTCAGATCACTAGAAGCTTTATTGCGGTAGTTTATCACAGTTAAATTGCTAACGC
AGTCAGTGCTTCTGACACAACAGTCTCGAACTTAAGGCTAGAGTTCGACGCCACCATGCGCGTGCGCGGCATCCCCCGCAACT
GGCCCCAGTGGTGGATCTGGGGCATCCTGGGCTTCTGGATGATCATCATCTGCCGCGTGGTGGGCAACCTGGACCTGTGGGT
GACCGTGTACTACGGCGTGCCCGTGTGGAAGGAGGCCAAGACCACCCTGTTCTGCGCCTCCGACGCCAAGGCCTACGACAAG
GAGGTGCACAACGTGTGGGCCACCCACGCCTGCGTGCCCACCGACCCCAACCCCAGGAGATCGTGCTGGAGAACGTGACCG
AGAACTTCAACATGTGGAAGAACGACATGGTGGACCAGATGCACGAGGACATCATCTCCCTGTGGGACCAGTCCCTGAAGCC
CTGCGTGAAGCTGACCCCCCTGTGCGTGACCCTGAACTGCAAGAACGTGAACATCTCCGCCAACGCCAACGCCACCGCCACCC
TGAACTCCTCCATGAACGGCGAGATCAAGAACTGCTCCTTCAACACCACCACCGAGCTGCGCGACAAGAAGCAGAAGGTGTAC
GCCCTGTTCTACAAGCCCGACGTGGTGCCCCTGAACGGCGGCGAGCACAACGAGACCGGCGAGTACATCCTGATCAACTGCA
ACTCCTCCACCATCACCCAGGCCTGCCCCAAGGTGTCCTTCGACCCCATCCCCATCCACTACTGCGCCCCCGCCGGCTACGCCAT
CCTGAAGTGCAACAACAAGACCTTCAACGGCACCGGCCCCTGCAACAACGTGTCCACCGTGCAGTGCACCCACGGCATCAAGC
CCGTGGTGTCCACCCAGCTGCTGCTGAACGGCTCCCTGGCCGAGGAGGAGATCATCGTGCGCTCCGAGAACCTGACCAACAAC
ATCAAGACCATCATCGTGCACCTGAACAAGTCCGTGGAGATCAAGTGCACCCGCCCCAACAACAACACCCGCAAGTCCGTGCG
CATCGGCCCCGGCCAGACCTTCTACGCCACCGGCGAGATCATCGGCGACATCCGCGAGGCCCACTGCAACATCTCCCGCGAGA
CCTGGAACTCCACCCTGATCCAGGTGAAGGAGAAGCTGCGCGAGCACTACAACAAGACCATCAAGTTCGAGCCCTCCTCCGGC
GGCGACCTGGAGGTGACCACCCACTCCTTCAACTGCCGCGGCGAGTTCTTCTACTGCGACACCACCAAGCTGTTCAACGAGAC
CAAGCTGTTCAACGAGTCCGAGTACGTGGACAACAAGACCATCATCCTGCCCTGCCGCATCAAGCAGATCATCAACATGTGGC
AGGAGGTGGGCCGCGCCATGTACGCCCCCCCCATCGAGGGCAACATCACCTGCAAGTCCAACATCACCGGCCTGCTGCTGACC
TGGGACGGCGGCGAGAACTCCACCGAGGGCGTGTTCCGCCCCGGCGGCGGCAACATGAAGGACAACTGGCGCTCCGAGCTG
TACAAGTACAAGGTGGTGGAGATCAAGCCCCTGGGCGTGGCCCCCACCAAGTCCAAGCTGACCGTGCAGGCCCGCCAGCTGC
TGTCCGGCATCGTGCAGCAGCAGTCCAACCTGCTGCGCGCCATCGAGGCCCAGCAGCACCTGCTGCAGCTGACCGTGTGGGG
CATCAAGCAGCTGCAGACCCGCGTGCTGGCCATCGAGCGCTACCTGAAGGACCAGCAGCTGCTGGGCCTGTGGGGCTGCTCC
GGCAAGCTGATCTGCGCCACCGCCGTGCCCTGGAACTCCTCCTGGTCCAACAAGTCCCTGGGCGACATCTGGGACAACATGAC
CTGGATGCAGTGGGACCGCGAGATCTCCAACTACACCAACACCATCTTCCGCCTGCTGGAGGACTCCCAGAACCAGCAGGAGA
AGAACGAGAAGGACCTGCTGGCCCTGGACTCCTGGAAGAACCTGTGGAACTGGTTCGACATCACCAACTGGCTGTGGTAAGG
TACCTCTAGAGTCGACCCGGGCGGCCAAACCGCTGATCAGCCTCGACTGTGCCTTCTAGTTGCCAGCCATCTGTTGTTTGCCCC
TCCCCCGTGCCTTCCTTGACCCTGGAAGGTGCCACTCCCACTGTCCTTTCCTAATAAAATGAGGAAATTGCATCGCATTGTCTGA
GTAGGTGTCATTCTATTCTGGGGGGTGGGGTGGGCAGGACAGCAAGGGGGAGGATTGGGAAGACAATAGCAGGCATGCT
GGGGATGCGGTGGGCTCTATGGCTTCTGAGGCGGAAAGAACCAGCAGATCTGCAGATCTGAATTCATCTATGTCGGGTGCGG
AGAAAGAGGTAATGAAATGGCATTATGGGTATTATGGGTCTGCATTAATGAATCGGTCAGATATCGACATATGCTGGCCACCG
TGCATGTGGCCTCGCACCCCCGCAAGACATGGCCCGAGTTCGAGCACAACGTCATGACCCGCTGCAATGTGCACCTGGGCTCC
CGCCGAGGCATGTTCATGCCCTACCAGTGCAACATGCAATTTGTGAAGGTGCTGCTGGAGCCCGATGCCATGTCCAGAGTGAG
CCTGACGGGGTGTTTGACATGAATGTGGAGCTGTGGAAAATTCTGAGATATGATGAATCCAAGACCAGGTGCCGGGCCTGC
GAATGCGGAGGCAAGCACGCCAGGCTTCAGCCCGTGTGTGTGGAGGTGACGGAGGACCTGCGACCCGATCATTTGGTGTTGT
CCTGCAACGGGACGGAGTTCGGCTCCAGCGGGGAAGAATCTGACTAGAGTGAGTAGTGTTTGGGGCTGGGTGTGAGCCTGC
```

Fig. 20B

```
ATGAGGGGCAGAATGACTAAAATCTGTGGTTTTCTGTGTGTTGCAGCAGCATGAGCGGAAGCGCCTCCTTTGAGGGAGGGGT
ATTCAGCCCTTATCTGACGGGGCGTCTCCCCTCCTGGGCGGGAGTGCGTCAGAATGTGATGGGATCCACGGTGGACGGCCGG
CCCGTGCAGCCCGCGAACTCTTCAACCCTGACCTACGCGACCCTGAGCTCCTCGTCCGTGGACGCAGCTGCCGCCGCAGCTGCT
GCTTCCGCCGCCAGCGCCGTGCGCGGAATGGCCCTGGGCGCCGGCTACTACAGCTCTCTGGTGGCCAACTCGAGTTCCACCAA
TAATCCCGCCAGCCTGAACGAGGAGAAGCTGCTGCTGCTGATGGCCCAGCTCGAGGCCCTGACCCAGCGCCTGGGCGAGCTG
ACCCAGCAGGTGGCTCAGCTGCAGGCGGAGACGCGGGCCGCGGTTGCCACGGTGAAAACCAAATAAAAAATGAATCAATAA
ATAAACGGAGACGGTTGTTGATTTTAACACAGAGTCTTGAATCTTTATTTGATTTTTCGCGCGCGGTAGGCCCTGGACCACCGG
TCTCGATCATTGAGCACCCGGTGGATCTTTTCCAGGACCCGGTAGAGGTGGGCTTGGATGTTGAGGTACATGGGCATGAGCCC
GTCCCGGGGGTGGAGGTAGCTCCATTGCAGGGCCTCGTGCTCGGGGATGGTGTTGTAAATCACCCAGTCATAGCAGGGGCGC
AGGGCGTGGTGCTGCACGATGTCCTTGAGGAGGAGACTGATGGCCACGGGCAGCCCCTTGGTGTAGGTGTTGACGAACCTGT
TGAGCTGGGAGGGATGCATGCGGGGGGAGATGAGATGCATCTTGGCCTGGATCTTGAGATTGGCGATGTTCCCGCCCAGATC
CCGCCGGGGGTTCATGTTGTGCAGGACCACCAGCACGGTGTATCCGGTGCACTTGGGGAATTTGTCATGCAACTTGGAAGGG
AAGGCGTGAAAGAATTTGGAGACGCCCTTGTGACCGCCCAGGTTTTCCATGCACTCATCCATGATGATGGCGATGGGCCCGTG
GGCGGCGGCCTGGGCAAAGACGTTTCGGGGGTCGGACACATCGTAGTTGTGGTCCTGGGTGAGCTCGTCATAGGCCATTTTA
ATGAATTTGGGGCGGAGGGTGCCCGACTGGGGGACGAAGGTGCCCTCGATCCCGGGGGCGTAGTTGCCCTCGCAGATCTGC
ATCTCCCAGGCCTTGAGCTCGGAGGGGGGATCATGTCCACCTGCGGGGCGATGAAAAAAACGGTTTCCGGGGCGGGGGAG
ATGAGCTGGGCCGAAAGCAGGTTCCGGAGCAGCTGGGACTTGCCGCAACCGGTGGGGCCGTAGATGACCCCGATGACCGGC
TGCAGGTGGTAGTTGAGGGAGAGACAGCTGCCGTCCTCGCGGAGGAGGGGGGCCACCTCGTTCATCATCTCGCGCACATGCA
TGTTCTCGCGCACGAGTTCCGCCAGGAGGCGCTCGCCCCCAGCGAGAGGAGCTCTTGCAGCGAGGCGAAGTTTTTCAGCGG
CTTGAGTCCGTCGGCCATGGGCATTTTGGAGAGGGTCTGTTGCAAGAGTTCCAGACGGTCCCAGAGCTCGGTGATGTGCTCTA
GGGCATCTCGATCCAGCAGACCTCCTCGTTTCGCGGGTTGGGGCGACTGCGGGAGTAGGGCACCAGGCGATGGGCGTCCAGC
GAGGCCAGGGTCCGGTCCTTCCAGGGCCGCAGGGTCCGCGTCAGCGTGGTCTCCGTCACGGTGAAGGGGTGCGCGCCGGGC
TGGGCGCTTGCGAGGGTGCGCTTCAGGCTCATCCGGCTGGTCGAGAACCGCTCCCGGTCGGCGCCCTGCGCGTCGGCCAGGT
AGCAATTGAGCATGAGTTCGTAGTTGAGCGCCTCGGCCGCGTGGCCCTTGGCGCGGAGCTTACCTTTGGAAGTGTGTCCGCAG
ACGGGACAGAGGAGGGACTTGAGGGCGTAGAGCTTGGGGGCGAGGAAGACGGACTCGGGGGCGTAGGCGTCCGCGCCGC
AGCTGGCGCAGACGGTCTCGCACTCCACGAGCCAGGTGAGGTCGGGGCGGTTGGGGTCAAAAACGAGGTTTCCTCCGTGCTT
TTTGATGCGTTTCTTACCTCTGGTCTCCATGAGCTCGTGTCCCGCTGGGTGACAAAGAGGCTGTCCGTGTCCCCGTAGACCGA
CTTTATGGGCCGGTCCTCGAGCGGGGTGCCGCGGTCCTCGTCGTAGAGGAACCCCGCCCACTCCGAGACGAAGGCCCGGGTC
CAGGCCAGCACGAAGGAGGCCACGTGGGAGGGGTAGCGGTCGTTGTCCACCAGCGGGTCCACCTTCTCCAGGGTATGCAAG
CACATGTCCCCCTCGTCCACATCCAGGAAGGTGATTGGCTTGTAAGTGTAGGCCACGTGACCGGGGGTCCCGGCCGGGGGGG
TATAAAAGGGGGCGGGCCCCTGCTCGTCCTCACTGTCTTCCGGATCGCTGTCCAGGAGCGCCAGCTGTTGGGGTAGGTATTCC
CTCTCGAAGGCGGGCATGACCTCGGCACTCAGGTTGTCAGTTTCTAGAAACGAGGAGGATTTGATATTGACGGTGCCGTTGGA
GACGCCTTTCATGAGCCCCTCGTCCATTTGGTCAGAAAAGACGATCTTTTTGTTGTCGAGCTTGGTGGCGAAGGAGCCGTAGA
GGGCGTTGGAGAGCAGCTTGGCGATGGAGCGCATGGTCTGGTTCTTTTCCTTGTCGGCGCGCTCCTTGGCGGCGATGTTGAGC
TGCACGTACTCGCGCGCCACGCACTTCCATTCGGGGAAGACGGTGGTGAGCTCGTCGGGCACGATTCTGACCCGCCAGCCGC
GGTTGTGCAGGGTGATGAGGTCCACGCTGGTGGCCACCTCGCCGCGCAGGGGCTCGTTGGTCCAGCAGAGGCGCCCGCCCTT
GCGCGAGCAGAAGGGGGGCAGCGGGTCCAGCATGAGCTCGTCGGGGGGTCGGCGTCCACGGTGAAGATGCCGGGCAGGA
GCTCGGGGTCGAAGTAGCTGATGCAGGTGCCCAGATTGTCCAGCGCCGCTTGCCAGTCGCGCACGGCCAGCGCGCGCTCGTA
GGGGCTGAGGGGCGTGCCCCAGGGCATGGGTGCGTGAGCGCGGAGGCGTACATGCCGCAGATGTCGTAGACGTAGAGGG
GCTCCTCGAGGACGCCGATGTAGGTGGGGTAGCAGCGCCCCCGCGGATGCTGGCGCGCACGTAGTCGTACAGCTCGTGCGA
GGGCGCGAGGAGCCCCGTGCCGAGGTTGGAGCGTTGCGGCTTTTCGGCGCGGTAGACGATCTGGCGGAAGATGGCGTGGGA
GTTGGAGGAGATGGTGGGCCTTTGGAAGATGTTGAAGTGGGCGTGGGGCAGGCCGACCGAGTCCCTGATGAAGTGGGCGTA
GGAGTCCTGCAGCTTGGCGACGAGCTCGGCGGTGACGAGGACGTCCAGGGCGCAGTAGTCGAGGGTCTCTTGGATGATGTC
ATACTTGAGCTGGCCCTTCTGCTTCCACAGCTCGCGGTTGAGAAGGAACTCTTCGCGGTCCTTCCAGTACTCTTCGAGGGGGAA
CCCGTCCTGATCGGCACGGTAAGAGCCCACCATGTAGAACTGGTTGACGGCCTTGTAGGCGCAGCAGCCCTTCTCCACGGGGA
GGGCGTAAGCTTGCGCGGCCTTGCGCAGGGAGGTGTGGGTGAGGGCGAAGGTGTCGCGCACCATGACCTTGAGGAACTGGT
GCTTGAAGTCGAGGTCGTCGCAGCCGCCCTGCTCCAGAGTTGGAAGTCCGTGCGCTTCTTGTAGGCGGGGTTAGGCAAAGC
GAAAGTAACATCGTTGAAGAGGATCTTGCCCGCGCGGGGCATGAAGTTGCGAGTGATGCGGAAAGGCTGGGGCACCTCGGC
CCGGTTGTTGATGACCTGGGCGGCGAGGACGATCTCGTCGAAGCCGTTGATGTTGTGCCCGACGATGTAGAGTTCCACGAATC
GCGGGCGGCCCTTGACGTGGGGCAGCTTCTTGAGCTCGTCGTAGGTGAGCTCGGCGGGGTCGCTGAGCCCGTGCTGCTCGAG
```

Fig. 20C

```
GGCCCAGTCGGCGACGTGGGGGTTGGCGCTGAGGAAGGAAGTCCAGAGATCCACGGCCAGGGCGGTCTGCAAGCGGTCCCG
GTACTGACGGAACTGTTGGCCCACGGCCATTTTTTCGGGGGTGACGCAGTAGAAGGTGCGGGGGTCGCCGTGCCAGCGGTCC
CACTTGAGCTGGAGGGCGAGGTCGTGGGCGAGCTCGACGAGCGGCGGGTCCCCGGAGAGTTTCATGACCAGCATGAAGGGG
ACGAGCTGCTTGCCGAAGGACCCCATCCAGGTGTAGGTTTCCACATCGTAGGTGAGGAAGAGCCTTTCGGTGCGAGGATGCG
AGCCGATGGGGAAGAACTGGATCTCCTGCCACCAGTTGGAGGAATGGCTGTTGATGTGATGGAAGTAGAAATGCCGACGGC
GCGCCGAGCACTCGTGCTTGTGTTTATACAAGCGTCCGCAGTGCTCGCAACGCTGCACGGGATGCACGTGCTGCACGAGCTGT
ACCTGGGTTCCTTTGGCGAGGAATTTCAGTGGGCAGTGGAGCGCTGGCGGCTGCATCTCGTGCTGTACTACGTCTTGGCCATC
GGCGTGGCCATCGTCTGCCTCGATGGTGGTCATGCTGACGAGCCCGCGCGGGAGGCAGGTCCAGACCTCGGCTCGGACGGGT
CGGAGAGCGAGGACGAGGGCGCGCAGGCCGGAGCTGTCCAGGGTCCTGAGACGCTGCGGAGTCAGGTCAGTGGGCAGCGG
CGGCGCGCGGTTGACTTGCAGGAGCTTTTCCAGGGCGCGCGGGAGGTCCAGATGGTACTTGATCTCCACGGCGCCGTTGGTG
GCTACGTCCACGGCTTGCAGGGTGCCGTGCCCCTGGGGCGCCACCACCGTGCCCCGTTTCTTCTTGGGCGCTGCTTCCATGTCG
GTCAGAAGCGGCGGCGAGGACGCGCGCCGGGCGGCAGGGGCGGCTCGGGGCCCGGAGGCAGGGGCGGCAGGGGCACGTC
GGCGCCGCGCGGGCAGGTTCTGGTACTGCGCCCGGAGAAGACTGGCGTGAGCGACGACGCGACGGTTGACGTCCTGGAT
CTGACGCCTCTGGGTGAAGGCCACGGGACCCGTGAGTTTGAACCTGAAAGAGAGTTCGACAGAATCAATCTCGGTATCGTTG
ACGGCGGCCTGCCGCAGGATCTCTTGCACGTCGCCCGAGTTGTCCTGGTAGGCGATCTCGGTCATGAACTGCTCGATCTCCTCC
TCCTGAAGGTCTCCGCGGCCGGCGCGCTCGACGGTGGCCGCGAGGTCGTTGGAGATGCGGCCCATGAGCTGCGAGAAGGCG
TTCATGCCGGCCTCGTTCCAGACGCGGCTGTAGACCACGGCTCCGTCGGGGTCGCGCGCGCATGACCACCTGGGCGAGGT
TGAGCTCGACGTGGCGCGTGAAGACCGCGTAGTTGCAGAGGCGCTGGTAGAGGTAGTTGAGCGTGGTGGCGATGTGCTCGG
TGACGAAGAAGTACATGATCCAGCGGCGGAGCGGCATCTCGCTGACGTCGCCCAGGGCTTCCAAGCGTTCCATGGCCTCGTA
GAAGTCCACGGCGAAGTTGAAAAACTGGGAGTTGCGCGCCGAGACGGTCAACTCCTCCTCCAGAAGACGGATGAGCTCGGCG
ATGGTGGCGCGCACCTCGCGCTCGAAGGCCCCGGGGGGCTCCTCTTCCATCTCCTCCTCTTCCTCCTCCACTAACATCTCTTCTA
CTTCCTCCTCAGGAGGCGGTGGCGGGGAGGGGCCCTGCGTCGCCGGCGGCGCACGGGCAGACGGTCGATGAAGCGCTCGA
TGGTCTCCCCGCGCCGGCGACGCATGGTCTCGGTGACGGCGCGCCCGTCCTCGCGGGGCCGCAGCATGAAGACGCCGCCGCG
CATCTCCAGGTGGCCGCCGGGGGGGTCTCCGTTGGGCAGGGAGAGGGCGCTGACGATGCATCTTATCAATTGACCCGTAGGG
ACTCCGCGCAAGGACCTGAGCGTCTCGAGATCCACGGGATCCGAAAACCGCTGAACGAAGGCTTCGAGCCAGTCGCAGTCGC
AAGGTAGGCTGAGCCCGGTTTCTTGTTCTTCGGGTATTTGGTCGGGAGGCGGGCGGGCGATGCTGCTGGTGATGAAGTTGAA
GTAGGCGGTCCTGAGACGGCGGATGGTGGCGAGGAGCACCAGGTCCTTGGGCCCGGCTTGCTGGATGCGCAGACGGTCGGC
CATGCCCCAGGCGTGGTCCTGACACCTGGCGAGGTCCTTGTAGTAGTCCTGCATGAGCCGCTCCACGGGCACCTCCTCCTCGCC
CGCGCGGCCGTGCATGCGCGTGAGCCCGAACCCGCGCTGCGGCTGGACGAGCGCCAGGTCGGCGACGACGCGCTCGGTGAG
GATGGCCTGCTGGATCTGGGTGAGGGTGGTCTGGAAGTCGTCGAAGTCGACGAAGCGGTGGTAGGCTCCGGTGTTGATGGT
GTAGGAGCAGTTGGCCATGACGGACCAGTTGACGGTCTGGTGGCCGGGTCGCACGAGCTCGTGGTACTTGAGGCGCGAGTA
GGCGCGCGTGTCGAAGATGTAGTCGTTGCAGGCGCGCACGAGGTACTGGTATCCGACGAGGAAGTGCGGCGGCGGCTGGCG
GTAGAGCGGCCATCGCTCGGTGGCGGGGGCGCCGGGCGCGAGGTCCTCGAGCATGAGGCGGTGGTAGCCGTAGATGTACCT
GGACATCCAGGTGATGCCGGCGGCGGTGGTGGAGGCGCGCGGGAACTCGCGGACGCGGTTCCAGATGTTGCGCAGCGGCA
GGAAGTAGTTCATGGTGGCCGCGGTCTGGCCCGTGAGGCGCGCGCAGTCGTGGATGCTCTAGACATACGGGCAAAAACGAA
AGCGGTCAGCGGCTCGACTCCGTGGCCTGGAGGCTAAGCGAACGGGTTGGGCTGCGCGTGTACCCCGGTTCGAATCTCGAAT
CAGGCTGGAGCCGCAGCTAACGTGGTACTGGCACTCCCGTCTCGACCCAAGCCTGCTAACGAAACCTCCAGGATACGGAGGC
GGGTCGTTTTTTGGCCTTGGTCGCTGGTCATGAAAAACTAGTAAGCGCGGAAAGCGGCCGCCCGCGATGGCTCGCTGCCGTA
GTCTGGAGAAAGAATCGCCAGGGTTGCGTTGCGGTGTGCCCCGGTTCGAGCCTCAGCGCTCGGCGCCGGCCGGATTCCGCGG
CTAACGTGGGCGTGGCTGCCCCGTCGTTTCCAAGACCCCTTAGCCAGCCGACTTCTCCAGTTACGGAGCGAGCCCCTCTTTTTTT
TTCTTGTGTTTTTGCCAGATGCATCCCGTACTGCGGCAGATGCGCCCCACCCTCCACCACAACCGCCCCTACCGCAGCAGCAG
CAACAGCCGGCGCTTCTGCCCCCGCCCCAGCAGCAGCCAGCCACTACCGCGGCGGCCGCCGTGAGCGGAGCCGGCGTTCAGT
ATGACCTGGCCTTGGAAGAGGGCGAGGGGCTGGCGCGGCTGGGGCGTCGTCGCCGGAGCGGCACCCGCGCGTGCAGATG
AAAAGGGACGCTCGCGAGGCCTACGTGCCCAAGCAGAACCTGTTCAGAGACAGGAGCGGCGAGGAGCCCGAGGAGATGCGC
GCCTCCCGCTTCCACGCGGGGCGGGAGCTGCGGCGCGGCCTGGACCGAAAGCGGGTGCTGAGGGACGAGGATTTCGAGGCG
GACGAGCTGACGGGGATCAGCCCCGCGCGCGCACGTGGCCGCGGCCAACCTGGTCACGGCGTACGAGCAGACCGTGAAG
GAGGAGAGCAACTTCCAAAAATCCTTCAACAACCACGTGCGCACGCTGATCGCGCGCGAGGAGGTGACCCTGGGCCTGATGC
ACCTGTGGGACCTGCTGGAGGCCATCGTGCAGAACCCCACGAGCAAGCCGCTGACGGCGCAGCTGTTTCTGGTGGTGCAGCA
CAGTCGGGACAACGAGACGTTCAGGGAGGCGCTGCTGAATATCACCGAGCCCGAGGGCCGCTGGCTCCTGGACCTGGTGAAC
ATTTTGCAGAGCATCGTGGTGCAGGAGCGCGGGCTGCCGCTGTCCGAGAAGCTGGCGGCCATCAACTTCTCGGTGCTGAGTC
```

Fig. 20D

```
TGGGCAAGTACTACGCTAGGAAGATCTACAAGACCCCGTACGTGCCCATAGACAAGGAGGTGAAGATCGACGGGTTTTACAT
GCGCATGACCCTGAAAGTGCTGACCCTGAGCGACGATCTGGGGGTGTACCGCAACGACAGGATGCACCGCGCGGTGAGCGC
CAGCCGCCGGCGCGAGCTGAGCGACCAGGAGCTGATGCACAGCCTGCAGCGGGCCCTGACCGGGGCCGGGACCGAGGGGG
AGAGCTACTTTGACATGGGCGCGGACCTGCGCTGGCAGCCCAGCCGCCGGGCCTTGGAAGCTGCCGGCGGTTCCCCCTACGT
GGAGGAGGTGGACGATGAGGAGGAGGAGGGCGAGTACCTGGAAGACTGATGGCGCGACCGTATTTTTGCTAGATGCAGCA
ACAGCCACCGCCGCCGCCTCCTGATCCCGCGATGCGGGCGGCGCTGCAGAGCCAGCCGTCCGGCATTAACTCCTCGGACGATT
GGACCCAGGCCATGCAACGCATCATGGCGCTGACGACCCGCAATCCCGAAGCCTTTAGACAGCAGCCTCAGGCCAACCGGCTC
TCGGCCATCCTGGAGGCCGTGGTGCCCTCGCGCTCGAACCCCACGCACGAGAAGGTGCTGGCCATCGTGAACGCGCTGGTGG
AGAACAAGGCCATCCGCGGTGACGAGGCCGGGCTGGTGTACAACGCGCTGCTGGAGCGCGTGGCCCGCTACAACAGCACCA
ACGTGCAGACGAACCTGGACCGCATGGTGACCGACGTGCGCGAGGCGGTGTCGCAGCGCGAGCGGTTCCACCGCGAGTCGA
ACCTGGGCTCCATGGTGGCGCTGAACGCCTTCCTGAGCACGCAGCCCGCCAACGTGCCCCGGGGCCAGGAGGACTACACCAA
CTTCATCAGCGCGCTGCGGCTGATGGTGGCCGAGGTGCCCCAGAGCGAGGTGTACCAGTCGGGGCCGGACTACTTCTTCCAG
ACCAGTCGCCAGGGCTTGCAGACCGTGAACCTGAGCCAGGCTTTCAAGAACTTGCAGGGACTGTGGGGCGTGCAGGCCCCGG
TCGGGGACCGCGCGACGGTGTCGAGCCTGCTGACGCCGAACTCGCGCCTGCTGCTGCTGCTGGTGGCGCCCTTCACGGACAG
CGGCAGCGTGAGCCGCGACTCGTACCTGGGCTACCTGCTTAACCTGTACCGCGAGGCCATCGGACAGGCGCACGTGGACGAG
CAGACCTACCAGGAGATCACCCACGTGAGCCGCGCGCTGGGCCAGGAGGACCCGGGCAACCTGGAGGCCACCCTGAACTTCC
TGCTGACCAACCGGTCGCAGAAGATCCCGCCCCAGTACGCGCTGAGCACCGAGGAGGAGCGCATCCTGCGCTACGTGCAGCA
GAGCGTGGGGCTGTTCCTGATGCAGGAGGGGGCCACGCCCAGCGCGGCGCTCGACATGACCGCGCGCAACATGGAGCCCAG
CATGTACGCCCGCAACCGCCCGTTCATCAATAAGCTGATGGACTACTTGCATCGGGCGGCCGCCATGAACTCGGACTACTTTAC
CAACGCCATCTTGAACCCGCACTGGCTCCCGCCGCCCGGGTTCTACACGGGCGAGTACGACATGCCCGACCCCAACGACGGGT
TCCTGTGGGACGACGTGGACAGCAGCGTGTTCTCGCCGCGTCCAGGAACCAATGCCGTGTGGAAGAAAGAGGGCGGGGACC
GGCGGCCGTCCTCGGCGCTGTCCGGTCGCGCGGGTGCTGCCGCGGCGGTGCCCGAGGCCGCCAGCCCCTTCCCGAGCCTGCC
CTTTTCGCTGAACAGCGTGCGCAGCAGCGAGCTGGGTCGGCTGACGCGACCGCGCCTGCTGGGCGAGGAGGAGTACCTGAAC
GACTCCTTGTTGAGGCCCGAGCGCGAGAAGAACTTCCCCAATAACGGGATAGAGAGCCTGGTGGACAAGATGAGCCGCTGGA
AGACGTACGCGCACGAGCACAGGGACGAGCCCCGAGCTAGCAGCGCAGGCACCCGTAGACGCCAGCGGCACGACAGGCAGC
GGGGACTGGTGTGGGACGATGAGGATTCCGCCGACGACAGCAGCGTGTTGGACTTGGGTGGGAGTGGTGGTAACCCGTTCG
CTCACCTGCGCCCCGTATCGGGCGCCTGATGTAAGAATCTGAAAAAATAAAAGACGGTACTCACCAAGGCCATGGCGACCAG
CGTGCGTTCTTCTCTGTTGTTTGTAGTAGTATGATGAGGCGCGTGTACCCGGAGGGTCCTCCTCCCTCGTACGAGAGCGTGATG
CAGCAGGCGGTGGCGGCGGCGATGCAGCCCCCGCTGGAGGCGCCTTACGTGCCCCGCGGTACCTGGCGCCTACGGAGGGG
CGGAACAGCATTCGTTACTCGGAGCTGGCACCCTTGTACGATACCACCCGGTTGTACCTGGTGGACAACAAGTCGGCAGACAT
CGCCTCGCTGAACTACCAGAACGACCACAGCAACTTCCTGACCACCGTGGTGCAGAACAACGATTTCACCCCCACGGAGGCCA
GCACCCAGACCATCAACTTTGACGAGCGCTCGCGGTGGGGCGGCCAGCTGAAAACCATCATGCACACCAACATGCCCAACGT
GAACGAGTTCATGTACAGCAACAAGTTCAAGGCGCGGGTGATGGTCTCGCGCAAGACCCCCAACGGGGTGGATGATGATTAT
GATGGTAGTCAGGACGAGCTGACCTACGAGTGGGTGGAGTTTGAGCTGCCCGAGGGCAACTTCTCGGTGACCATGACCATCG
ATCTGATGAACAACGCCATCATCGACAACTACTTGGCGGTGGGGCGGCAGAACGGGGTGCTGGAGAGCGACATCGGCGTGA
AGTTCGACACGCGCAACTTCCGGCTGGGCTGGGACCCCGTGACCGAGCTGGTGATGCCGGGCGTGTACACCAACGAGGCCTT
CCACCCCGACATCGTCCTGCTGCCCGGCTGCGGCGTGGACTTCACCGAGAGCCGCCTCAGCAACCTGCTGGGCATCCGCAAGC
GGCAGCCCTTCCAGGAGGGCTTCCAGATCCTGTACGAGGACCTGGAGGGGGGCAACATCCCCGCGCTCTTGGATGTCGAAGC
CTACGAGAAAAGCAAGGAGGATAGCACCGCCGCGGCGACCGCAGCCGTGGCCACCGCCTCTACCGAGGTGCGGGGCGATAA
TTTTGCTAGCGCTGCGGCAGCGGCCGAGGCGGCTGAAACCGAAAGTAAGATAGTCATCCAGCCGGTGGAGAAGGACAGCAA
GGACAGGAGCTACAACGTGCTCGCGGACAAGAAAAACACCGCCTACCGCAGCTGGTACCTGGCCTACAACTACGGCGACCCC
GAGAAGGGCGTGCGCTCCTGGACGCTGCTCACCACCTCGGACGTCACCTGCGGCGTGGAGCAAGTCTACTGGTCGCTGCCCG
ACATGATGCAAGACCCGGTCACCTTCCGCTCCACGCGTCAAGTTAGCAACTACCCGGTGGTGGGCGCCGAGCTCCTGCCCGTC
TACTCCAAGAGCTTCTTCAACGAGCAGGCCGTCTACTCGCAGCAGCTGCGCGCCTTCACCTCGCTCACGCACGTCTTCAACCGC
TTCCCCGAGAACCAGATCCTCGTCCGCCCGCCGCGCCCACCATTACCACCGTCAGTGAAAACGTTCCTGCTCTCACAGATCAC
GGGACCCTGCCGCTGCGCAGCAGTATCCGGGGAGTCCAGCGCGTGACCGTCACTGACGCCAGACGCCGCACCTGCCCCTACG
TCTACAAGGCCCTGGGCGTAGTCGCGCCGCGCGTCCTCTCGAGCCGCACCTTCTAAAAAATGTCCATTCTCATCTCGCCCAGTA
ATAACACCGGTTGGGGCCTGCGCGCGCCCAGCAAGATGTACGGAGGCGCTCGCCAACGCTCCACGCAACACCCCGTGCGCGT
GCGCGGGCACTTCCGCGCTCCCTGGGGCGCCCTCAAGGGCCGCGTGCGCTCGCGCACCACCGTCGACGACGTGATCGACCAG
GTGGTGGCCGACGCGCGCAACTACACGCCCGCCGCCGCGCCCGTCTCCACCGTGGACGCCGTCATCGACAGCGTGGTGGCCG
```

Fig. 20E

ACGCGCGCCGGTACGCCCGCACCAAGAGCCGGCGGCGGCGCATCGCCCGGCGGCACCGGAGCACCCCCGCCATGCGCGCGG
CGCGAGCCTTGCTGCGCAGGGCCAGGCGCACGGGACGCAGGGCCATGCTCAGGGCGGCCAGACGCGCGGCCTCCGGCAGCA
GCAGCGCCGGCAGGACCCGCAGACGCGCGGCCACGGCGGCGGCGGCGGCCATCGCCAGCATGTCCCGCCCGCGGCGCGGCA
ACGTGTACTGGGTGCGCGACGCCGCCACCGGTGTGCGCGTGCCCGTGCGCACCCGCCCCCCTCGCACTTGAAGATGCTGACTT
CGCGATGTTGATGTGTCCCAGCGGCGAGGAGGATGTCCAAGCGCAAATACAAGGAAGAGATGCTCCAGGTCATCGCGCCTGA
GATCTACGGCCCCGCGGCGGCGGTGAAGGAGGAAAGAAAGCCCCGCAAACTGAAGCGGGTCAAAAAGGACAAAAAGGAGG
AGGAAGATGACGGACTGGTGGAGTTTGTGCGCGAGTTCGCCCCCCGGCGGCGCGTGCAGTGGCGCGGGCGGAAAGTGAAAC
CGGTGCTGCGGCCCGGCACCACGGTGGTCTTCACGCCCGGCGAGCGTTCCGGCTCCGCCTCCAAGCGCTCCTACGACGAGGT
GTACGGGGACGAGGACATCCTCGAGCAGGCGGTCGAGCGTCTGGGCGAGTTTGCGTACGGCAAGCGCAGCCGCCCCGCGCC
CTTGAAAGAGGAGGCGGTGTCCATCCCGCTGGACCACGGCAACCCCACGCCGAGCCTGAAGCCGGTGACCCTGCAGCAGGTG
CTACCGAGCGCGGCGCCGCGCCGGGGCTTCAAGCGCGAGGGCGGCGAGGATCTGTACCCGACCATGCAGCTGATGGTGCCC
AAGCGCCAGAAGCTGGAGGACGTGCTGGAGCACATGAAGGTGGACCCCGAGGTGCAGCCCGAGGTCAAGGTGCGGCCCATC
AAGCAGGTGGCCCCGGGCCTGGGCGTGCAGACCGTGGACATCAAGATCCCCACGGAGCCCATGGAAACGCAGACCGAGCCC
GTGAAGCCCAGCACCAGCACCATGGAGGTGCAGACGGATCCCTGGATGCCAGCACCAGCTTCCACCAGCACTCGCCGAAGAC
GCAAGTACGGCGCGGCCAGCCTGCTGATGCCCAACTACGCGCTGCATCCTTCCATCATCCCCACGCCGGGCTACGCGGCACG
CGCTTCTACCGCGGCTACACCAGCAGCCGCCGCCGCAAGACCACCACCCGCCGCCGTCGTCGCAGCCGCCGCAGCAGCACCGC
GACTTCCGCCTTGGTGCGGAGAGTGTATCGCAGCGGGCGCGAGCCTCTGACCCTGCCGCGCGCGCGCTACCACCCGAGCATC
GCCATTTAACTACCGCCTCCTACTTGCAGATATGGCCCTCACATGCCGCCTCCGCGTCCCCATTACGGGCTACCGAGGAAGAAA
GCCGCGCCGTAGAAGGCTGACGGGGAACGGGCTGCGTCGCCATCACCACCGGCGGCGGCGCGCCATCAGCAAGCGGTTGGG
GGGAGGCTTCCTGCCCGCGCTGATCCCCATCATCGCCGCGGCGATCGGGGCGATCCCCGGCATAGCTTCCGTGGCGGTGCAG
GCCTCTCAGCGCCACTGAGACACAAAAAAGCATGGATTTGTAATAAAAAAAAAAATGGACTGACGCTCCTGGTCCTGTGATGT
GTGTTTTTAGATGGAAGACATCAATTTTTCGTCCCTGGCACCGCGACACGGCACGCGGCCGTTTATGGGCACCTGGAGCGACA
TCGGCAACAGCCAACTGAACGGGGGCGCCTTCAATTGGAGCAGTCTCTGGAGCGGGCTTAAGAATTTCGGGTCCACGCTCAA
AACCTATGGCAACAAGGCGTGGAACAGCAGCACAGGGCAGGCGCTGAGGGAAAAGCTGAAAGAACAGAACTTCCAGCAGAA
GGTGGTTGATGGCCTGGCCTCAGGCATCAACGGGGTGGTTGACCTGGCCAACCAGGCCGTGCAGAAACAGATCAACAGCCGC
CTGGACGCGGTCCCGCCCGCGGGGTCCGTGGAGATGCCCCAGGTGGAGGAGGAGCTGCCTCCCCTGGACAAGCGCGGCGAC
AAGCGACCGCGTCCCGACGCGGAGGAGACGCTGCTGACGCACACGGACGAGCCGCCCCCGTACGAGGAGGCGGTGAAACTG
GGCCTGCCCACCACGCGGCCCGTGGCGCCTCTGGCCACCGGAGTGCTGAAACCCAGCAGCAGCCAGCCCGCGACCCTGGACT
TGCCTCCGCCTCGCCCCTCCACAGTGGCTAAGCCCTGCCGCCGGTGGCCGTCGCGTCGCGCGCCCCCGAGGCCGCCCCCAG
GCGAACTGGCAGAGCACTCTGAACAGCATCGTGGGTCTGGGAGTGCAGAGTGTGAAGCGCCGCCGCTGCTATTAAAAGACAC
TGTAGCGCTTAACTTGCTTGTCTGTGTGTATATGTATGTCCGCCGACCAGAAGGAGGAGTGTGAAGAGGCGCGTCGCCGAGTT
GCAAGATGGCCACCCCATCGATGCTGCCCCAGTGGGCGTACATGCACATCGCCGGACAGGACGCTTCGGAGTACCTGAGTCC
GGGTCTGGTGCAGTTCGCCCGCGCCACAGACACCTACTTCAGTCTGGGGAACAAGTTTAGGAACCCCACGGTGGCGCCCACGC
ACGATGTGACCACCGACCGCAGCCAGCGGCTGACGCTGCGCTTCGTGCCCGTGGACCGCGAGGACAACACCTACTCGTACAA
AGTGCGCTACACGCTGGCCGTGGGCGACAACCGCGTGCTGGACATGGCCAGCACCTACTTTGACATCCGCGGCGTGCTGGAC
CGGGGCCCTAGCTTCAAACCCTACTCTGGCACCGCCTACAACAGCCTAGCTCCCAAGGGAGCTCCCAATTCCAGCCAGTGGGA
GCAAGCAAAACAGGCAATGGGGGAACTATGGAAACACACACATATGGTGTGGCCCCAATGGGCGGAGAGAATATTACAAA
AGATGGTCTTCAAATTGGAACTGACGTTACAGCGAATCAGAATAAACCAATTTATGCCGACAAAACATTTCAACCAGAACCGC
AAGTAGGAGAAGAAAATTGGCAAGAAACTGAAAACTTTTATGGCGGTAGAGCTCTTAAAAAAGACACAAACATGAAACCTTG
CTATGGCTCCTATGCTAGACCCACCAATGAAAAGGAGGTCAAGCTAAACTTAAAGTTGGAGATGATGGAGTTCCAACCAAAG
AATTCGACATAGACCTGGCTTTCTTTGATACTCCCGGTGGCACCGTGAACGGTCAAGACGAGTATAAAGCAGACATTGTCATGT
ATACCGAAAACACGTATTTGGAAACTCCAGACACGCATGTGGTATACAAACCAGGCAAGGATGATGCAAGTTCTGAAATTAAC
CTGGTTCAGCAGTCTATGCCCAACAGACCCAACTACATTGGGTTCAGGGACAACTTTATCGGTCTTATGTACTACAACAGCACT
GGCAATATGGGTGTGCTTGCTGGTCAGGCCTCCCAGCTGAATGCTGTGGTTGATTTGCAAGACAGAAACACCGAGCTGTCCTA
CCAGCTCTTGCTTGACTCTTTGGGTGACAGAACCCGGTATTTCAGTATGTGGAACCAGGCGGTGGACAGTTATGACCCCGATG
TGCGCATCATCGAAAACCATGGTGTGGAGGATGAATTGCCAAACTATTGCTTCCCCTTGGACGGCTCTGGCACTAACGCCGCA
TACCAAGGTGTGAAAGTAAAAGATGGTCAAGATGGTGATGTTGAGAGTGAATGGGAAAATGACGATACTGTTGCAGCTCGAA
ATCAATTATGTAAAGGTAACATTTTCGCCATGGAGATTAATCTCCAGGCTAACCTGTGGAGAAGTTTCCTCTACTCGAACGTGG
CCCTGTACCTGCCCGACTCCTACAAGTACACGCCGACCAACGTCACGCTGCCGACCAACACCAACACCTACGATTACATGAATG
GCAGAGTGACACCTCCCTCGCTGGTAGACGCCTACCTCAACATCGGGGCGCGCTGGTCGCTGGACCCCATGGACAACGTCAAC

Fig. 20F

```
CCCTTCAACCACCACCGCAACGCGGGCCTGCGCTACCGCTCCATGCTCCTGGGCAACGGGCGCTACGTGCCCTTCCACATCCAG
GTGCCCCAAAAGTTTTTCGCCATCAAGAGCCTCCTGCTCCTGCCCGGGTCCTACACCTACGAGTGGAACTTCCGCAAGGACGTC
AACATGATCCTGCAGAGCTCCCTAGGCAACGACCTGCGCACGGACGGGGCCTCCATCGCCTTCACCAGCATCAACCTCTACGC
CACCTTCTTCCCCATGGCGCACAACACCGCCTCCACGCTCGAGGCCATGCTGCGCAACGACACCAACGACCAGTCCTTCAACGA
CTACCTCTCGGCGGCCAACATGCTCTACCCCATCCCGGCCAACGCCACCAACGTGCCCATCTCCATCCCCTCGCGCAACTGGGC
CGCCTTCCGCGGATGGTCCTTCACGCGCCTGAAGACCCGCGAGACGCCCTCGCTCGGCTCCGGGTTCGACCCCTACTTCGTCTA
CTCGGGCTCCATCCCCTACCTAGACGGCACCTTCTACCTCAACCACACCTTCAAGAAGGTCTCCATCACCTTCGACTCCTCCGTC
AGCTGGCCCGGCAACGACCGCCTCCTGACGCCCAACGAGTTCGAAATCAAGCGCACCGTCGACGGAGAGGGATACAACGTGG
CCCAGTGCAACATGACCAAGGACTGGTTCCTGGTCCAGATGCTGGCCCACTACAACATCGGCTACCAGGGCTTCTACGTGCCC
GAGGGCTACAAGGACCGCATGTACTCCTTCTTCCGCAACTTCCAGCCCATGAGCCGCCAGGTCGTGGACGAGGTCAACTACAA
GGACTACCAGGCCGTCACCCTGGCCTACCAGCACAACAACTCGGGCTTCGTCGGCTACCTCGCGCCCACCATGCGCCAGGGCC
AGCCCTACCCCGCCAACTACCCCTACCCGCTCATCGGCAAGAGCGCCGTCGCCAGCGTCACCCAGAAAAAGTTCCTCTGCGACC
GGGTCATGTGGCGCATCCCCTTCTCCAGCAACTTCATGTCCATGGGCGCGCTCACCGACCTCGGCCAGAACATGCTCTACGCCA
ACTCCGCCCACGCGCTAGACATGAATTTCGAAGTCGACCCCATGGATGAGTCCACCCTTCTCTATGTTGTCTTCGAAGTCTTCGA
CGTCGTCCGAGTGCACCAGCCCCACCGCGGCGTCATCGAAGCCGTCTACCTGCGCACGCCCTTCTCGGCCGGCAACGCCACCA
CCTAAGCCGCTCTTGCTTCTTGCAAGATGACGGCGGGCTCCGGCGAGCAGGAGCTCAGGGCCATCCTCCGCGACCTGGGCTGC
GGGCCCTGCTTCCTGGGCACCTTCGACAAGCGCTTCCCTGGATTCATGGCCCCGCACAAGCTGGCCTGCGCCATCGTGAACAC
GGCCGGCCGCGAGACCGGGGGCGAGCACTGGCTGGCCTTCGCCTGGAACCCGCGCTCCCACACATGCTACCTCTTCGACCCCT
TCGGGTTCTCGGACGAGCGCCTCAAGCAGATCTACCAGTTCGAGTACGAGGGCCTGCTGCGTCGCAGCGCCCTGGCCACCGA
GGACCGCTGCGTCACCCTGGAAAAGTCCACCCAGACCGTGCAGGGTCCGCGCTCGGCCGCCTGCGGGCTCTTCTGCTGCATGT
TCCTGCACGCCTTCGTGCACTGGCCCGACCGCCCCATGGACAAGAACCCCACCATGAACTTACTGACGGGGGTGCCCAACGGC
ATGCTCCAGTCGCCCCAGGTGGAACCCACCCTGCGCCGCAACCAGGAAGCGCTCTACCGCTTCCTCAATGCCCACTCCGCCTAC
TTTCGCTCCCACCGCGCGCGCATCGAGAAGGCCACCGCCTTCGACCGCATGAATCAAGACATGTAAAAAACCGGTGTGTGTAT
GTGAATGCTTTATTCATAATAAACAGCACATGTTTATGCCACCTTCTCTGAGGCTCTGACTTTATTTAGAAATCGAAGGGGTTCT
GCCGGCTCTCGGCATGGCCCGCGGGCAGGGATACGTTGCGGAACTGGTACTTGGGCAGCCACTTGAACTCGGGGATCAGCAG
CTTGGGCACGGGGAGGTCGGGGAACGAGTCGCTCCACAGCTTGCGCGTGAGTTGCAGGGCGCCCAGCAGGTCGGGCGCGGA
GATCTTGAAATCGCAGTTGGGACCCGCGTTCTGCGCGCGAGAGTTGCGGTACACGGGGTTGCAGCACTGGAACACCATCAGG
GCCGGGTGCTTCACGCTTGCCAGCACCGTCGCGTCGGTGATGCCCTCCACGTCCAGATCCTCGGCGTTGGCCATCCCGAAGGG
GGTCATCTTGCAGGTCTGCCGCCCCATGCTGGGCACGCAGCCGGGCTTGTGGTTGCAATCGCAGTGCAGGGGATCAGCATC
ATCTGGGCCTGCTCGGAGCTCATGCCCGGGTACATGGCCTTCATGAAAGCCTCCAGCTGGCGGAAGGCCTGCTGCGCCTTGCC
GCCCTCGGTGAAGAAGACCCCGCAGGACTTGCTAGAGAACTGGTTGGTGGCGCAGCCGGCGTCGTGCACGCAGCAGCGCGC
GTCGTTGTTGGCCAGCTGCACCACGCTGCGCCCCAGCGGTTCTGGGTGATCTTGGCCCGGTTGGGGTTCTCCTTCAGCGCGC
GCTGCCCGTTCTCGCTCGCCACATCCATCTCGATAGTGTGCTCCTTCTGGATCATCACGGTCCCGTGCAGGCACCGCAGCTTGC
CCTCGGCTTCGGTGCAGCCGTGCAGCCACAGCGCGCAGCCGGTGCACTCCCAGTTCTTGTGGGCGATCTGGGAGTGCGAGTG
CACGAAGCCCTGCAGGAAGCGGCCCATCATCGCGGTCAGGGTCTTGTTGCTGGTGAAGGTCAGCGGGATGCCGCGGTGCTCC
TCGTTCACATACAGGTGGCAGATGCGGCGGTACACCTCGCCCTGCTCGGGCATCAGCTGGAAGGCGGACTTCAGGTCGCTCTC
CACGCGGTACCGGTCCATCAGCAGCGTCATCACTTCCATGCCCTTCTCCCAGGCCGAAACGATCGGCAGGCTCAGGGGGTTCT
TCACCGCCATTGTCATCTTAGTCGCCGCCGCCGAGGTCAGGGGGTCGTTCTCGTCCAGGGTCTCAAACACTCGCTTGCCGTCCT
TCTCGATGATGCGCACGGGGGGAAAGCTGAAGCCCACGGCCGCCAGCTCCTCCTCGGCCTGCCTTTCGTCCTCGCTGTCCTGG
CTGATGTCTTGCAAAGGCACATGCTTGGTCTTGCGGGGTTTCTTTTTGGGCGGCAGAGGCGGCGGCGATGTGCTGGGAGAGC
GCGAGTTCTCGTTCACCACGACTATTTCTTCTTCTTGGCCGTCGTCCGAGACCACGCGGCGGTAGGCATGCCTCTTCTGGGGCA
GAGGCGGAGGCGACGGGCTCTCGCGGTTCGGCGGGCGGCTGGCAGAGCCCTTCCGCGTTCGGGGGTGCGCTCCTGGCGGC
GCTGCTCTGACTGACTTCCTCCGCGGCCGGCCATTGTGTTCTCCTAGGGAGCAACAACAAGCATGGAGACTCAGCCATCGTCG
CCAACATCGCCATCTGCCCCGCCGCCACCGCCGACGAGAACCAGCAGCAGAATGAAAGCTTAACCGCCCCGCCGCCCAGCCC
CACCTCCGACGCCGCGGCCCAGACATGCAAGAGATGGAGGAATCCATCGAGATTGACCTGGGCTACGTGACGCCCGCGGAG
CACGAGGAGGAGCTGGCAGCGCGCTTTTCAGCCCCGGAAGAGAACCACCAAGAGCAGCCAGAGCAGGAAGCAGAGAACGA
GCAGAACCAGGCTGGGCACGAGCATGGCGACTACCTGAGCGGGGCAGAGGACGTGCTCATCAAGCATCTGGCCCGCCAATG
CATCATCGTCAAGGACGCGCTGCTCGACCGCGCCGAGGTGCCCCTCAGCGTGGCGGAGCTCAGCCGCGCCTACGAGCGCAAC
CTCTTCTCGCCGCGCGTGCCCCCAAGCGCCAGCCCAACGGCACCTGTGAGCCCAACCCGCGCCTCAACTTCTACCCGGTCTTC
GCGGTGCCCGAGGCCCTGGCCACCTACCACCTCTTTTTCAAGAACCAAAGGATCCCCGTCTCCTGCCGCGCCAACCGCACCCGC
```

Fig. 20G

```
GCCGACGCCCTGCTCAACCTGGGCCCCGGCGCCCGCCTACCTGATATCACCTCCTTGGAAGAGGTTCCCAAGATCTTCGAGGG
TCTGGGCAGCGACGAGACTCGGGCCGCGAACGCTCTGCAAGGAAGCGGAGAGGAGCATGAGCACCACAGCGCCCTGGTGGA
GTTGGAAGGCGACAACGCGCGCCTGGCGGTCCTCAAGCGCACGGTCGAGCTGACCCACTTCGCCTACCCGGCGCTCAACCTGC
CCCCCAAGGTCATGAGCGCCGTCATGGACCAGGTGCTCATCAAGCGCGCCTCGCCCCTCTCGGAGGAGGAGATGCAGGACCC
CGAGAGTTCGGACGAGGGCAAGCCCGTGGTCAGCGACGAGCAGCTGGCGCGCTGGCTGGGAGCGAGTAGCACCCCCCAGAG
CCTGGAAGAGCGGCGCAAGCTCATGATGGCCGTGGTCCTGGTGACCGTGGAGCTGGAGTGTCTGCGCCGCTTCTTTGCCGAC
GCGGAGACCCTGCGCAAGGTCGAGGAGAACCTGCACTACCTCTTCAGGCACGGGTTCGTGCGCCAGGCCTGCAAGATCTCCA
ACGTGGAGCTGACCAACCTGGTCTCCTACATGGGCATCCTGCACGAGAACCGCCTGGGGCAAAACGTGCTGCACACCACCCTG
CGCGGGGAGGCCCGCCGCGACTACATCCGCGACTGCGTCTACCTGTACCTCTGCCACACCTGGCAGACGGGCATGGGCGTGT
GGCAGCAGTGCCTGGAGGAGCAGAACCTGAAAGAGCTCTGCAAGCTCCTGCAGAAGAACCTCAAGGCCCTGTGGACCGGGTT
CGACGAGCGTACCACCGCCTCGGACCTGGCCGACCTCATCTTCCCCGAGCGCCTGCGGCTGACGCTGCGCAACGGGCTGCCCG
ACTTTATGAGCCAAAGCATGTTGCAAAACTTTCGCTCTTTCATCCTCGAACGCTCCGGGATCCTGCCCGCCACCTGCTCCGCGCT
GCCCTCGGACTTCGTGCCGCTGACCTTCCGCGAGTGCCCCCGCCGCTCTGGAGCCACTGCTACTTGCTGCGCCTGGCCAACTA
CCTGGCCTACCACTCGGACGTGATCGAGGACGTCAGCGGCGAGGGTCTGCTGGAGTGCCACTGCCGCTGCAACCTCTGCACG
CCGCACCGCTCCCTGGCCTGCAACCCCCAGCTGCTGAGCGAGACCCAGATCATCGGCACCTTCGAGTTGCAAGGCCCCGGCGA
CGGCGAGGGCAAGGGGGGTCTGAAACTCACCCCGGGGCTGTGGACCTCGGCCTACTTGCGCAAGTTCGTGCCCGAGGACTAC
CATCCCTTCGAGATCAGGTTCTACGAGGACCAATCCCAGCCGCCCAAGGCCGAGCTGTCGGCCTGCGTCATCACCCAGGGGGC
CATCCTGGCCCAATTGCAAGCCATCCAGAAATCCCGCCAAGAATTTCTGCTGAAAAAGGGCCACGGGGTCTACTTGGACCCCC
AGACCGGAGAGGAGCTCAACCCCAGCTTCCCCCAGGATGCCCCGAGGAAGCAGCAAGAAGCTGAAAGTGGAGCTGCCGCCG
CCGGAGGATTTGGAGGAAGACTGGGAGAGCAGTCAGGCAGAGGAGGAGGAGATGGAAGACTGGGACAGCACTCAGGCAG
AGGAGGACAGCCTGCAAGACAGTCTGGAGGAGGAAGACGAGGTGGAGGAGGCAGAGGAAGAAGCAGCCGCCGCCAGACC
GTCGTCCTCGGCGGAGAAAGCAAGCAGCACGGATACCATCTCCGCTCCGGGTCGGGGTCGCGGCGGCCGGGCCCACAGTAG
GTGGGACGAGACCGGGCGCTTCCCGAACCCCACCACCCAGACCGGTAAGAAGGAGCGGCAGGGATACAAGTCCTGGCGGGG
GCACAAAAACGCCATCGTCTCCTGCTTGCAAGCCTGCGGGGGCAACATCTCCTTCACCCGGCGCTACCTGCTCTTCCACCGCGG
GGTGAACTTCCCCCCGCAACATCTTGCATTACTACCGTCACCTCCACAGCCCCTACTACTGTTTCCAAGAAGAGGCAGAAACCCA
GCAGCAGCAGAAAACCAGCGGCAGCAGCAGCTAGAAAATCCACAGCGGCGGCAGGTGGACTGAGGATCGCGGCGAACGAG
CCGGCGCAGACCCGGGAGCTGAGGAACCGGATCTTTCCCACCCTCTATGCCATCTTCCAGCAGAGTCGGGGGCAGGAGCAGG
AACTGAAAGTCAAGAACCGTTCTCTGCGCTCGCTCACCCGCAGTTGTCTGTATCACAAGAGCGAAGACCAACTTCAGCGCACTC
TCGAGGACGCCGAGGCTCTCTTCAACAAGTACTGCGCGCTCACTCTTAAAGAGTAGCCCGCGCCCGCCCACACACGGAAAAAG
GCGGGAATTACGTCACCACCTGCGCCCTTCGCCCGACCATCATGAGCAAAGAGATTCCCACGCCTTACATGTGGAGCTACCAG
CCCCAGATGGGCCTGGCCGCCGGCGCCGCCCAGGACTACTCCACCCGCATGAACTGGCTCAGTGCCGGGCCCGCGATGATCTC
ACGGGTGAATGACATCCGCGCCCACCGAAACCAGATACTCCTAGAACAGTCAGCGATCACCGCCACGCCCCGCCATCACCTTA
ATCCGCGTAATTGGCCCGCCGCCCTGGTGTACCAGGAAATTCCCCAGCCCACGACCGTACTACTTCCGCGAGACGCCCAGGCC
GAAGTCCAGCTGACTAACTCAGGTGTCCAGCTGGCCGGCGGCGCCGCCCTGTGTCGTCACCGCCCCGCTCAGGGTATAAAGCG
GCTGGTGATCCGAGGCAGAGGCACACAGCTCAACGACGAGGTGGTGAGCTCTTCGCTGGGTCTGCGACCTGACGGAGTCTTC
CAACTCGCCGGATCGGGGAGATCTTCCTTCACGCCTCGTCAGGCCGTCCTGACTTTGGAGAGTTCGTCCTCGCAGCCCCGCTCG
GGCGGCATCGGCACTCTCCAGTTCGTGGAGGAGTTCACTCCCTCGGTCTACTTCAACCCCTTCTCCGGCTCCCCGGCCACTAC
CCGGACGAGTTCATCCCGAACTTCGACGCCATCAGCGAGTCGGTGGACGGCTACGATTGAATGTCCCATGGTGGCGCAGCTG
ACCTAGCTCGGCTTCGACACCTGGACCACTGCCGCCGCTTCCGCTGCTTCGCTCGGGATCTCGCCGAGTTTGCCTACTTTGAGC
TGCCCGAGGAGCACCCTCAGGGCCCAGCCCACGGAGTGCGGATCATCGTCGAAGGGGCCTCGACTCCCACCTGCTTCGGAT
CTTCAGCCAGCGACCGATCCTGGTCGAGCGCGAACAAGGACAGACCCTTCTTACTTTGTACTGCATCTGCAACCACCCCGGCCT
GCATGAAAGTCTTTGTTGTCTGCTGTGTACTGAGTATAATAAAAGCTGAGATCAGCGACTACTCCGGACTCGATTGTGGTGTTC
CTGCTATCAACCGGTCCCTGTTCTTCACCGGGAACGAGACCGAGCTCCAGCTCCAGTGTAAGCCCCACAAGAAGTACCTCACCT
GGCTGTTCCAGGGCTCCCCGATCGCCGTTGTCAACCACTGCGACAACGACGGAGTCCTGCTGAGCGGCCCTGCCAACCTTACTT
TTTCCACCCGCAGAAGCAAGCTCCAGCTCTTCCAACCCTTCCTCCCCGGGACCTATCAGTGCGTCTCAGGACCCTGCCATCACAC
CTTCCACCTGATCCCGAATACCACAGCGCCGCTCCCCGCTACTAACAACCAAACTACCCACCAACGCCACCGTCGCGACCTTTCC
TCTGAATCTAATACCACTACCGGAGGTGGCTTCTGCTGTTAGTGCTCCCCCGTCCCGTCGACCCCCGGTCCCCCACTCAGTCCCC
CGAGGAGGTTCGCAAATGCAAATTCCAAGAACCCTGGAAATTCCTCAAATGCTACCGCCAAAAATCAGACATGCATCCCAGCT
GGATCATGATCATTGGGATCGTGAACATTCTGGCCTGCACCCTCATCTCCTTTGTGATTTACCCCTGCTTTGACTTTGGTTGGAA
CTCGCCAGAGGCGCTCTATCTCCCGCCTGAACCTGACACACCACCACAGCAGCAACCTCAGGCACACGCACTACCACCACCACA
```

Fig. 20H

```
GCCTAGGCCACAATACATGCCCATATTAGACTATGAGGCCGAGCCACAGCGACCCATGCTCCCCGCTATTAGTTACTTCAATCT
AACCGGCGGAGATGACTGACCCACTGGCCAATAACAACGTCAACGACCTTCTCCTGGACATGGACGGCCGCGCCTCGGAGCA
GCGACTCGCCCAACTTCGCATTCGTCAGCAGCAGGAGAGAGCCGTCAAGGAGCTGCAGGACGGCATAGCCATCCACCAGTGC
AAGAGAGGCATCTTCTGCCTGGTGAAACAGGCCAAGATCTCCTACGAGGTCACCCAGACCGACCATCGCCTCTCCTACGAGCT
CCTGCAGCAGCGCCAGAAGTTCACCTGCCTGGTCGGAGTCAACCCCATCGTCATCACCCAGCAGTCGGGCGATACCAAGGGGT
GCATCCACTGCTCCTGCGACTCCCCCGACTGCGTCCACACTCTGATCAAGACCCTCTGCGGCCTCCGCGACCTCCTCCCCATGAA
CTAATCACCCCCTTATCCAGTGAAATAAAGATCATATTGATGATGATTTAAATAAAAAAAATAATCATTTGATTTGAAATAAAGA
TACAATCATATTGATGATTTGAGTTTAACAAAAATAAAGAATCACTTACTTGAAATCTGATACCAGGTCTCTGTCCATGTTTTCT
GCCAACACCACCTCACTCCCCTCTTCCCAGCTCTGGTACTGCAGGCCCCGGCGGGCTGCAAACTTCCTCCACACGCTGAAGGGG
ATGTCAAATTCCTCCTGTCCCTCAATCTTCATTTTATCTTCTATCAGATGTCCAAAAAGCGCGTCCGGGTGGATGATGACTTCGA
CCCCGTCTACCCCTACGATGCAGACAACGCACCGACCGTGCCCTTCATCAACCCCCCCTTCGTCTCTTCAGATGGATTCCAAGAG
AAGCCCCTGGGGGTGTTGTCCCTGCGACTGGCTGACCCCGTCACCACCAAGAACGGGGAAATCACCCTCAAGCTGGGAGAGG
GGGTGGACCTCGACTCGTCGGGAAAACTCATCTCCAACACGGCCACCAAGGCCGCCGCCCCTCTCAGTATTTCAAACAACACC
ATTTCCCTTAAAACTGCTGCCCCTTTCTACAACAACAATGGAACTTTAAGCCTCAATGTCTCCACACCATTAGCAGTATTTCCCAC
ATTTAACACTTTAGGCATAAGTCTTGGAAACGGTCTTCAGACTTCAAATAAGTTGTTGACTGTACAACTAACTCATCCTCTTACA
TTCAGCTCAAATAGCATCACAGTAAAAACAGACAAAGGGCTATATATTAACTCCAGTGGAAACAGAGGACTTGAGGCTAATAT
AAGCCTAAAAAGAGGACTAGTTTTTGACGGTAATGCTATTGCAACATATATTGGAAATGGCTTAGACTATGGATCTTATGATAG
TGATGGAAAACAAGACCCGTAATTACCAAAATTGGAGCAGGATTAAATTTTGATGCTAACAAAGCAATAGCTGTCAAACTAG
GCACAGGTTTAAGTTTTGACTCCGCTGGTGCCTTGACAGCTGGAAACAAACAGGATGACAAGCTAACACTTTGGACTACCCCT
GACCCAAGCCCTAATTGTCAATTACTTTCAGACAGAGATGCCAAATTTACTCTCTGTCTTACAAAATGCGGTAGTCAAATACTAG
GCACTGTGGCAGTGGCGGCTGTTACTGTAGGATCAGCACTAAATCCAATTAATGACACAGTCAAAAGCGCCATAGTTTTCCTTA
GATTTGATTCCGATGGTGTACTCATGTCAAACTCATCAATGGTAGGTGATTACTGGAACTTTAGGGAGGGACAGACCACTCAA
AGTGTAGCCTATACAAATGCTGTGGGATTCATGCCAAATATAGGTGCATATCCAAAAACCCAAAGTAAAACACCTAAAAATAG
CATAGTCAGTCAGGTATATTTAACTGGAGAAACTACTATGCCAATGACACTAACCATAACTTTCAATGGCACTGATGAAAAAGA
CACAACCCCAGTTAGCACCTACTCTATGACTTTTACATGGCAGTGGACTGGAGACTATAAGGACAAAAATATTACCTTTGCTAC
CAACTCATTCTCTTTTTCCTACATCGCCCAGGAATAATCCACCCAGCAAGCCAACCCCTTTTCCCACCACCTTTGTCTATATGGA
AACTCTGAAACAGAAAAATAAAGTTCAAGTGTTTTATTGAATCAACAGTTTTACAGGACTCGAGCAGTTATTTTTCCTCCACCCT
CCCAGGACATGGAATACACCACCCTCTCCCCCCGCACAGCCTTGAACATCTGAATGCCATTGGTGATGGACATGCTTTTGGTCT
CCACGTTCCACACAGTTTCAGAGCGAGCCAGTCTCGGATCGGTCAGGGAGATGAAACCCTCCGGGCACTCCCGCATCTGCACC
TCACAGCTCAACAGCTGAGGATTGTCCTCGGTGGTCGGGATCACGGTTATCTGGAAGAAGCAGAAGAGCGGCGGTGGGAATC
ATAGTCCGCGAACGGGATCGGCCGGTGGTGTCGCATCAGGCCCCGCAGCAGTCGCTGCCGCCGCCGCTCCGTCAAGCTGCTG
CTCAGGGGGTTCGGGTCCAGGGACTCCCTCAGCATGATGCCCACGGCCCTCAGCATCAGTCGTCGGTGCGGGGGCGCAGC
AGCGCATGCGAATCTCGCTCAGGTCACTGCAGTACGTGCAACACAGGACCACCAGGTTGTTCAACAGTCCATAGTTCAACACG
CTCCAGCCGAAACTCATCGCGGGAAGGATCGCTACCCACGTGGCCGTCGTACCAGATCCTCAGGTAAATCAAGTGGCGCTCCT
CCAGAAGCGCTGCCCATGTACATGATCTCCTTGGGCATGTGGCGGTTCACCACCTCCCGGTACCACATCACCCTCTGGTTGAA
CATGCAGCCCCGGATGATCCTGCGGAACCACAGGGCCAGCACCGCCCGCCCGCCATGCAGCGAAGAGACCCCGGATCCCGG
CAATGACAATGGAGGACCCACCGCTCGTACCCGTGGATCATCTGGGAGCTGAACAAGTCTATGTTGGCACAGCACAGGCATAT
GCTCATGCATCTCTTCAGCACTCTCAGCTCCTCGGGGTCAAAACCATATCCCAGGGCACGGGGAACTCTTGCAGGACAGCGA
ACCCCGCAGAACAGGGCAATCCTCGCACATAACTTACATTGTGCATGGACAGGGTATCGCAATCAGGCAGCACCGGGTGATCC
TCCACCAGAGAAGCGCGGGTCTCGGTCTCCTCACAGCGTGGTAAGGGGCCGGCCGATACGGGTGATGGCGGGACGCGGCT
GATCGTGTTCTCGACCGTGTCATGATGCAGTTGCTTTCGGACATTTTCGTACTTGCTGTAGCAGAACCTGGTCCGGGCGCTGCA
CACCGATCGCCGGCGGCGGTCTCGGCGCTTGGAACGCTCGGTGTTAAAGTTGTAAAACAGCCACTCTCTCAGACCGTGCAGCA
GATCTAGGGCCTCAGGAGTGATGAAGATCCCATCATGCCTGATAGCTCTGATCACATCGACCACCGTGGAATGGGCCAGGCCC
AGCCAGATGATGCAATTTTGTTGGGTTTCGGTGACGGCGGGGAGGGAAGAACAGGAAGAACCATGATTAACTTTTAATCCA
AACGGTCTCGGAGCACTTCAAAATGAAGGTCACGGAGATGGCACCTCTCGCCCCCGCTGTGTTGGTGGAAAATAACAGCCAG
GTCAAAGGTGATACGGTTCTCGAGATGTTCCACGGTGGCTTCCAGCAAAGCCTCCACGCGCACATCCAGAAACAAGACAATAG
CGAAAGCGGGAGGGTTCTCTAATTCCTCAACCATCATGTTACACTCCTGCACCATCCCCAGATAATTTTCATTTTTCCAGCCTTG
AATGATTCGAACTAGTTCCTGAGGTAAATCCAAGCCAGCCATGATAAAAAGCTCGCGCAGAGCACCCTCCACCGGCATTCTTAA
GCACACCCTCATAATTCCAAGATATTCTGCTCCTGGTTCACCTGCAGCAGATTGACAAGCGGAATATCAAAATCTCTGCCGCGA
TCCCTGAGCTCCTCCCTCAGCAATAACTGTAAGTACTCTTTCATATCGTCTCCGAAATTTTTAGCCATAGGACCCCCAGGAATAA
GAGAAGGGCAAGCCACATTACAGATAAACCGAAGTCCCCCCAGTGAGCATTGCCAAATGTAAGATTGAAATAAGCATGCTG
GCTAGACCCGGTGATATCTTCCAGATAACTGGACAGAAAATCGGGTAAGCAATTTTTAAGAAAATCAACAAAGAAAAATCTT
CCAGGTGCACGTTTAGGGCCTCGGGAACAACGATGGAGTAAGTGCAAGGGGTGCGTTCCAGCATGGTTAGTTAGCTGATCTG
TAAAAAAACAAAAAATAAAACATTAAACATGCTAGCCTGGCGAACAGGTGGGTAAATCGTTCTCTCCAGCACCAGGCAGGCC
ACGGGGTCTCCGGCGCGACCCTCGTAAAAATTGTCGCTATGATTGAAAACCATCACAGAGACGCGTTCCCGGTGGCCGGCGT
GAATGATTCGAGAAGAAGCATACACCCCGGAACATTGGAGTCCGTGAGTGAAAAAAAGCGGCCGAGGAAGCAATGAGGCA
CTACAACGCTCACTCTCAAGTCCAGCAAAGCGATGCCATGCGGATGAAGCACAAAATTTTCAGGTGCGTAAAAAATGTAATTA
CTCCCCTCCTGCACAGGCAGCGAAGCTCCCGATCCCTCCAGATACACATACAAAGCCTCAGCGTCCATAGCTTACCGAGCGGCA
GCAGCAGCGGCACACAACAGGCGCAAGAGTCAGAGAAAGACTGAGCTCTAACCTGTCCGCCCGCTCTCTGCTCAATATATAG
CCCCAGATCTACACTGACGTAAAGGCCAAAGTCTAAAAATACCCGCCAAATAATCACACACGCCCAGCACACGCCCAGAAACC
GGTGACACACTCAGAAAAATACGCGCACTTCCTCAAACGGCCAAACTGCCGTCATTTCCGGGTTCCCACGCTACGTCATCAAAA
CACGACTTTCAAATTCCGTCGACCGTTAAAAACATCACCCGCCCCGCCCCTAACGGTCGCCGCTCCCGCAGCCAATCACCTTCCT
CCCTCCCCAAATTCAAACAGCTCATTTGCATATTAACGCGCACCAAAAGTTTGAGGTATATTATTGATGATG
```

Fig. 20I

AdC6 020-HIVgp140(E1572)  Amino acids -- SEQ ID NO: 9
The symbol " * " refers herein to stop codons in the non coding regions

```
HHQ*YTSNFWCALICK*AV*IWGGRKVIGCGSGDR*GRGG*RFDDVAMRRSRFASSRGKSDVKRGVV*TRKYSIFPRSLTGNEVFL
GGCK*KRAIFARKLNEEVKI*VISRLWQGGVFAEGRVDFDRLRGGFDYRIFHLNFRVRCQSPVFLRTISFPRKCHLTVTITVLR*RKLRS
PDPLWCTLSTICSDAA*LSQYLLPACVLEVAE*CASKI*ATTRQGLTDNCMKNLLRVRRFALLRDVRARYTR*H*LLTSMPSTPPIDVN
DGKWPAWHYAQYMTLWDFPTWQYIYVLVIAITMVMRFWQYINGRG*RFDSRGFPSLHPIDVNGSLFWHQNQRDFPKCRNNSA
PLTQMGGRRVRWEVYISRARLVNRQITRSFIAVVYHS*IANAVSASDTTVSNLRLEFDATMRVRGIPRNWPQWWIWGILGFWMIII
CRVVGNLDLWVTVYYGVPVWKEAKTTLFCASDAKAYDKEVHNVWATHACVPTDPNPQEIVLENVTENFNMWKNDMVDQMHE
DIISLWDQSLKPCVKLTPLCVTLNCKNVNISANANATATLNSSMNGEIKNCSFNTTTELRDKKQKVYALFYKPDVVPLNGGEHNETGE
YILINCNSSTITQACPKVSFDPIPIHYCAPAGYAILKCNNKTFNGTGPCNNVSTVQCTHGIKPVVSTQLLLNGSLAEEEIIVRSENLTNNIK
TIIVHLNKSVEIKCTRPNNNTRKSVRIGPGQTFYATGEIIGDIREAHCNISRETWNSTLIQVKEKLREHYNKTIKFEPSSGGDLEVTTHSF
NCRGEFFYCDTTKLFNETKLFNESEYVDNKTIILPCRIKQIINMWQEVGRAMYAPPIEGNITCKSNITGLLLTWDGGENSTEGVFRPG
GGNMKDNWRSELYKYKVVEIKPLGVAPTKSKLTVQARQLLSGIVQQQSNLLRAIEAQQHLLQLTVWGIKQLQTRVLAIERYLKDQQL
LGLWGCSGKLICATAVPWNSSWSNKSLGDIWDNMTWMQWDREISNYTNTIFRLLEDSQNQQEKNEKDLLALDSWKNLWNWF
DITNWLW*GTSRVDPGGQTADQPRLCLLVASHLLFAPPPCLP*PWKVPLPLSFPNKMRKLHRIV*VGVILFWGVGWGRTARGRIG
KTIAGMLGMRWALWLLRRKEPADLQI*IHLCRVRRKRNGIMGIMGLHIGQISTYAGHRACGLAPPQDMARVRAQRHDPLQ
CAPGLPPRHVHALPVQHAICEGAAGARCHVQSEPDGGV*HECGAVENSEI**IQDQVPGLRMRRQARQASARVCGGDGGPATRS
FGVVLQRDGVRLQRGRI*LE*VVFGAGCEPA*GAE*LKSVVFCVLQQHERKRLL*GRGIQPLSDGASPLLGGSASECDGIHGGRPAR
AARELFNPDLRDPELLVRGRSCRRSCCFRRQRRARNGPGRRLLQLSGGQLEFHQ*SRQPERGEAAAADGPARGPDPAPGRADPAG
GSAAGGDAGRGCHGENQIKNESINKRRRLLILTQSLESLFDFSRAVGPGPPVSIIEHPVDLFQDPVEVGLDVEVHGHEPVPGVEVAPL
QGLVLGDGVVNHPVIAGAQGVVLHDVLEEETDGHGQPLGVGVDEPVELGGMHAGGDEMHLGLDLEIGDVPAQIPPGVHVVQD
HQHGVSGALGEFVMQLGREGVKEFGDALVTAQVFHALIHDDGDGPVGGGLGKDVSGVGHIVVVVLGELVIGHFNEFGAEGARLG
DEGALDPGGVVALADLHLPGLELGGGDHVHLRGDEKNGFRGGGDELGRKQVPEQLGLAATGGAVDDPDDRLQVVVEGETAAVL
AEEGGHLVHHLAHMHVLAHEFRQEALAPQREELLQRGEVFQRLESVGHGHFGEGLLQEFQTVPELGDVL*GISIQQTSSFRGLGRL
RE*GTRRWASSEARVRSFQGRRVRVSVVSVTVKGCAPGWALARVRFRLIRLVENRSRSAPCASAR*QLSMSS*LSASAAWPLARSL
PLEVCPQTGQRRDLRA*SLGARKTDSGA*ASAPQLAQTVSHSTSQVRSGRLGSKTRFPPCFLMRFLPLVSMSSCPRWVTKRLSVSP*
TDFMGRSSSGVPRSSS*RNPAHSETKARVQASTKEATWEG*RSLSTSGSTFSRVCKHMSPSSTSRKVIGL*V*AT*PGVPAGGV*KG
AGPCSSSLSSGSLSRSASCWGRYSLSKAGMTSALRLSVSRNEEDLILTVPLETPFMSPSSIWSEKTIFLLSSLVAKEP*RALESSLAMER
MVWFFSLSARSLAAMLSCTYSRATHFHSGKTVVSSSGTILTRQPRLCRVMRSTLVATSPRRGSLVQQRRPPLREQKGGSGSSMSSSG
GSASTVKMPGRSSGSK*LMQVPRLSSAACQSRTASARS*GLRGVPQGMGCVSAEAYMPQMS*T*RGSSRTPM*VG*QRPPRML
ART*SYSSCEGARSPVPRLERCGFSAR*TIWRKMAWELEEMVGLWKMLKWAWGRPTESLMKWA*ESCSLATSSAVTRTSRAQ*S
RVSWMMSYLSWPFCFHSSRLRRNSSRSFQYSSRGNPS*SAR*EPTM*NWLTAL*AQQPFSTGRA*ACAALRREVMWVRAKVSRTM
TLRNWCLKSRSSQPPCSQSWKSVRFL*AGLGKAKVTSLKRILPARGMKLRVMRKGWGTSARLLMTWAARTISSKPLMLCPTM*SS
TNRGRPLTWGSFLSSS*VSSAGSLSPCCSRAQSATWGLALRKEVQRSTARAVCKRSRY*RNCWPTAIFSGVTQ*KVRGSPCQRSHLS
WRARSWASSTSGGSPESFMTSMKGTSCLPKDPIQV*VSTS*VRKSLSVRGCEPMGKNWISCHQLEEWLLM*WK*KCRRRAEHSC
LCLYKRPQCSQRCTGCTCCTSCTWVPLARNFSGQWSAGGCISCCTTSWPSAWPSSASMVVMLTSPRGRQVQTSARTGRRARTRA
RRPELSRVLRRCGVRSVGSGGARLTCRSFSRARGRSRWYLISTAPLVATSTACRVPCPWGATTVPRFFLGAASMSVRSGGEDARRA
AGAARGPEAGAAGARRRRARAGSGTAPGEDWRERRRDG*RPGSDASG*RPRDP*V*T*KRVRQNQSRYR*RRPAAGSLARRPSC
PGRRSRS*TARSPPPEGLRGRRARRWPRGRWRCGP*AARRRSCRPRSRRGCRPRLRRGRARA*PPGRG*ARRGA*RPRSCRGAG
RGS*AWWRCAR*RRST*SSGGAASR*RRPGLPSVPWPRRSPRRS*KTGSCAPRRSTPPPEDG*ARRWWRAPRARRPRGAPLPSP
PLPPPLTSLLLPPQEAVAGEGPCVAGGARADGR*SARWSPRAGDAWSR*RRARPRGAAA*RRRRASPGGRRGGLRWAGRGR*R
CILSIDP*GLRART*ASRDPRDPKTAERRLRASRSRKVG*ARFLVLRVFGREAGGRCCW**S*SRRS*DGGWWRGAPGPWARLAG
CADGRPCPRRGPDTWRGPCSSPA*AAPRAPPPRPRGRACA*ARTRAAAGRAPGRRRRAR*GWPAGSG*GWSGSRRSRRSGGRL
RC*WCRSSWP*RTS*RSGGRVARARGT*GASRRACRRCSRCRRARGTGIRRGSAAAAGGRAAIARWRGRRARGPRA*GGGSRRC
TWTSR*CRRRWWRRAGTRGRGSRCCAAAGSSSWWPRSGP*GARSRGCSRHTGKNESGQRLDSVAWRLSERVGLRVYPGSNLES
GWSRS*RGTGTPVSTQAC*RNLQDTEAGRFLALVAGHEKLVSAESGRPRWLAAVVWRKNRQGCVAVCPGSSLSARRRPDSAANV
GVAAPSFPRPLSQPTSPVTERAPLFFSCVFARCIPYCGRCAPTLHHNRPYRSSSNSRRFCPRPSSSQPLPRRPP*AEPAFSMTWPWKR
ARGWRGWGRRRRSGTRACR*KGTLARPTCPSRTCSETGAARSPRRCAPPASTRGGSCGAAWTESGC*GTRISRRTS*RGSAPRAR
TWPRPTWSRRTSRP*RRRATSKNPSTTTCAR*SRARR*PWA*CTCGTCWRPSCRTPRASR*RRSCFWWCSTVGTTRRSGRRC*ISP
```

Fig. 20J

```
SPRAAGSWTW*TFCRASWCRSAGCRCPRSWRPSTSRC*VWASTTLGRSTRPRTCP*TRR*RSTGFTCA*P*KC*P*ATIWGCTATT
GCTAR*APAAGAS*ATRS*CTACSGP*PGPGPRGRATLTWARTCAGSPAAGPWKLPAVPPTWRRWTMRRRRASTWKTDGATVF
LLDAATATAAAS*SRDAGGGAAEPAVRH*LLGRLDPGHATHHGADDPQSRSL*TAASGQPALGHPGGRGALALEPHAREGAGHRE
RAGGEQGHPR*RGRAGVQRAAGARGPLQQHQRADEPGPHGDRRARGGVAARAVPPRVEPGLHGGAERLPEHAARQRAPGPG
GLHQLHQRAAADGGRGAPERGVPVGAGLLLPDQSPGLADREPEPGFQELAGTVGRAGPGRGPRDGVEPADAELAPAAAAGGAL
HGQRQREPRLVPGLPA*PVPRGHRTGARGRADLPGDHPREPRAGPGGPGQPGGHPELPADQPVAEDPAPVRAEHRGGAHPALR
AAERGAVPDAGGGHAQRGARHDRAQHGAQHVRPQPPVHQ*ADGLLASGGRHELGLLYQRHLEPALAPAARVLHGRVRHARPQ
RRVPVGRRGQQRVLAASRNQCRVEERGRGPAAVLGAVRSRGCCRGGARGRQPLPEPALFAEQRAQQRAGSADATAPAGRGGVP
ERLLVEARAREELPQ*RDREPGGQDEPLEDVRARAQGRAPS*QRRHP*TPAARQAAGTGVGR*GFRRRQQRVGLGWEWW*PV
RSPAPPYRAPDVRI*KNKRRYSPRPWRPACVLLCCL**YDEARVPGGSSSLVRERDAAGGGGGDAAPAGGALRAPAVPGAYGGAE
QHSLLGAGTLVRYHPVVPGGQQVGRHRLAELPERPQQLPDHRGAEQRFHPHGGQHPDHQL*RALAVGRPAENHHAHQHAQRE
RVHVQQQVQGAGDGLAQDPQRGG**L*W*SGRADLRVGGV*AARGQLLGDHDHRSDEQRHHRQLLGGGAAERGAGERHRRE
VRHAQLPAGLGPRDRAGDAGRVHQRGLPPRHRPAARLRRGLHREPPQQPAGHPQAAALPGGLPDPVRGPGGGQHPRALGCRSL
REKQGG*HRRGDRSRGHRLYRGAGR*FC*RCGSGRGG*NRK*DSHPAGGEGQQGQELQRARGQEKHRLPQLVPGLQLRRPREG
RALLDAAHHLGRHLRRGASLLVAARHDARPGHLPLHASS*QLPGGGRRAPARLLQELLQRAGRLLAAAARLHLAHARLQPLPREPD
PRPPARAHHYHRQ*KRSCSHRSRDPAAAQQYPGSPARDRH*RQTPHLPLRLQGPGRSRAARPLEPHLLKNVHSHLAQ**HRLGPA
RAQQDVRRRSPTLHATPRARARALPRSLGRPQGPRALAHHRRRRDRPGGGRRAQLHARRRARLHRGRRHRQRGGRRAPVRPHQ
EPAAAHRPAAPEHPRHARGASLAAQGQAHGTQGHAQGGQTRGLRQQQRRQDPQTRGHGGGGGHRQHVPPAARQRVLGARR
RHRCARARAHPPPSHLKMLTSRC*CVPAARRMSKRKYKEEMLQVIAPEIYGPAAAVKEERKPRKLKRVKKDKKEEEDDGLVEFVREF
APRRRVQWRGRKVKPVLRPGTTVVFTPGERSGSASKRSYDEVYGDEDILEQAVERLGEFAYGKRSRPAPLKEEAVSIPLDHGNPTPSL
KPVTLQQVLPSAAPRRGFKREGGEDLYPTMQLMVPKRQKLEDVLEHMKVDPEVQPEVKVRPIKQVAPGLGVQTVDIKIPTEPMET
QTEPVKPSTSTMEVQTDPWMPAPASTSTRRRRKYGAASLLMPNYALHPSIIPTPGYRGTRFYRGYTSSRRRKTTTRRRRRSRRSSTAT
SALVRRVYRSGREPLTLPRARYHPSIAI*LPPPTCRYGPHMPPPRPHYGLPRKKAAP*KADGERAASPSPPAAARHQQAVGGRLPAR
ADPHHRRGDRDGDPRHSFRGGAGLSAPLRHKKAWICNKKKNGLTLLVL*CVFLDGRHQFFVPGTATRHAAVYGHLERHRQQPTERG
RLQLEQSLERA*EFRVHAQNLWQQGVEQQHRAGAEGKAERTELPAEGG*WPGLRHQRGG*PGQPGRAETDQQPPGRGPARGV
RGDAPGGGGAASPGQARRQATASRRGGDAADAHGRAAPVRGGGETGPAHHAARGASGHRSAETQQQPARDPGLASASPLHSG
*APAAGGRRVARPPRPPPGELAEHSEQHRGSGSAECEAPPLLLKDTVALNLLVCVYMYVRRPEGGV*RGASPSCKMATPSMLPQW
AYMHIAGQDASEYLSPGLVQFARATDTYFSLGNKFRNPTVAPTHDVTTDRSQRLTLRFVPVDREDNTYSYKVRYTLAVGDNRVLDM
ASTYFDIRGVLDRGPSFKPYSGTAYNSLAPKGAPNSSQWEQAKTGNGGTMETHTYGVAPMGGENITKDGLQIGTDVTANQNKPIY
ADKTFQPEPQVGEENWQETENFYGGRALKKDTNMKPCYGSYARPTNEKGGQAKLKVGDDGVPTKEFDIDLAFFDTPGGTVNGQD
EYKADIVMYTENTYLETPDTHVVYKPGKDDASSEINLVQQSMPNRPNYIGFRDNFIGLMYYNSTGNMGVLAGQASQLNAVVDLQD
RNTELSYQLLLDSLGDRTRYFSMWNQAVDSYDPDVRIIENHGVEDELPNYCFPLDGSGTNAAYQGVKVKDGQDGDVESEWENDD
TVAARNQLCKGNIFAMEINLQANLWRSFLYSNVALYLPDSYKYTPTNVTLPTNTNTYDYMNGRVTPPSLVDAYLNIGARWSLDPM
DNVNPFNHHRNAGLRYRSMLLGNGRYVPFHIQVPQKFFAIKSLLLLPGSYTYEWNFRKDVNMILQSSLGNDLRTDGASIAFTSINLY
ATFFPMAHNTASTLEAMLRNDTNDQSFNDYLSAANMLYIPANATNVPISIPSRNWAAFRGWSFTRLKTRETPSLGSGFDPYFVYS
GSIPYLDGTFYLNHTFKKVSITFDSSVSWPGNDRLLTPNEFEIKRTVDGEGYNVAQCNMTKDWFLVQMLAHYNIGYQGFYVPEGYK
DRMYSFFRNFQPMSRQVVDEVNYKDYQAVTLAYQHNNSGFVGYLAPTMRQGQPYPANYPYPLIGKSAVASVTQKKFLCDRVMW
RIPFSSNFMSMGALTDLGQNMLYANSAHALDMNFEVDPMDESTLLYVVFEVFDVVRVHQPHRGVIEAVYLRTPFSAGNATT*AAL
ASCKMTAGSGEQELRAILRDLGCGPCFLGTFDKRFPGFMAPHKLACAIVNTAGRETGGEHWLAFAWNPRSHTCYLFDPFGFSDERL
KQIYQFEYEGLLRRSALATEDRCVTLEKSTQTVQGPRSAACGLFCCMFLHAFVHWPDRPMDKNPTMNLLTGVPNGMLQSPQVEP
TLRRNQEALYRFLNAHSAYFRSHRARIEKATAFDRMNQDM*KTGVCM*MLYS**TAHVYATFSEALTLFRNRRGSAGSRHGPRAGI
RCGTGTWAAT*TRGSAAWARGGRGTSRSTACA*VAGRPAGRARRS*NRSWDPRSARESCGTRGCSTGTPSGPGASRLPAPSRR*
CPPRPDPRRWPSRRGSSCRSAAPCWARSRACGCNRSAGGSASSGPARSSCPGTWPS*KPPAGGRPAAPCRPR*RRPRRTC*RTG
WWRSRRRARSSARRCWPAAPRCAPSGSG*SWPGWGSPSARAARSRSPHPSR*CAPSGSSRSAGTAACPRLRCSRAATARSRCT
PSSCGRSGSASARSPAGSGPSSRSGSCCW*RSAGCRGAPRSHTGGRCGGTPRPARASAGRRTSGRSPRGTGPSAASSLPCPSPRPK
RSAGSGGSSPPLSS*SPPPRSGGRSRPGSQTLACRPSR*CARGES*SPRPPAPPRPAFRPRCPG*CLAKAHAWSCGVSFWAAEAAA
MCWESASSRSPRLFLLLGRRPRPRGGRHASSGAEAEATGSRGSAGGWQSPFRVRGCAPGGAALTDFLRGRPLCSPREQQQAWRL
SHRRQHRHLPPPPPPTRTSSRMKA*PPRRPAPPPTPRPQTCKRWRNPSRLTWAT*RPRSTRRSWQRAFQPRKRTTKSSQSRKQRT
SRTRLGTSMATT*AGQRTCSSSIWPANASSSRTRCSTAPRCPSAWRSSAAPTSATSSRRACPPSASPTAPVSPTRASTSTRSSRCPRP
WPPTTSFSRTKGSPSPAAPTAPAPTPCSTWAPAPAYLISPPWKRFPRSSRVWAATRLGPRTLCKEAERSMSTTAPWWSWKATTRA
```

Fig. 20K

WRSSSARSS*PTSPTRRSTCPPRS*APSWTRCSSSAPRPSRRRRCRTPRVRTRASPWSATSSWRAGWERVAPPRAWKSGASS*WP
WSW*PWSWSVCAASLPTRRPCARSRRTCTTSSGTGSCARPARSPTWS*PTWSPTWASCTRTAWGKTCCTPPCAGRPAATTSATA
STCTSATPGRRAWACGSSAWRSRT*KSSASSCRRTSRPCGPGSTSVPPPRTWPTSSSPSACG*RCATGCPTL*AKACCKTFALSSSN
APGSCPPPAPRCPRTSCR*PSASAPRRSGATATCCAWPTTWPTTRT*SRTSAARVCWSATAAATSARRTAPWPATPSC*ARPRSSA
PSSCKAPATARARGV*NSPRGCGPRPTCASSCPRTTIPSRSGSTRTNPSRPRPSCRPASSPRGPSWPNCKPSRNPAKNFC*KRATGST
WTPRPERSSTPASPRMPRGSSKKLKVELPPPEDLEEDWESSQAEEEEMEDWDSTQAEEDSLQDSLEEEDEVEEAEEEAAAARPSSS
AEKASSTDTISAPGRGRGGRAHSRWDETGRFPNPTTQTGKKERQGYKSWRGHKNAIVSCLQACGGNISFTRRYLLFHRGVNFPRNI
LHYYRHLHSPYYCFQEEAETQQQQKTSGSSS*KIHSGGRWTEDRGERAGADPGAEEPDLSHPLCHLPAESGAGAGTESQEPFSALA
HPQLSVSQERRPTSAHSRGRRGSLQQVLRAHS*RVARARPHTEKGGNYVTTCALRPTIMSKEIPTPYMWSYQPQMGLAAGAAQD
YSTRMNWLSAGPAMISRVNDIRAHRNQILLEQSAITATPRHHLNPRNWPAALVYQEIPQPTTVLLPRDAQAEVQLTNSGVQLAGG
AALCRHRPAQGIKRLVIRGRGTQLNDEVVSSSLGLRPDGVFQLAGSGRSSFTPRQAVLTLESSSSQPRSGGIGTLQFVEEFTPSVYFNP
FSGSPGHYPDEFIPNFDAISESVDGYD*MSHGGAADLARLRHLDHCRRFRCFARDLAEFAYFELPEEHPQGPAHGVRIIVEGGLDSHL
LRIFSQRPILVEREQGQTLLTLYCICNHPGLHESLCCLLCTEYNKS*DQRLLRTRLWCSCYQPVPVLHRERDRAPAPV*APQEVPHLAV
PGLPDRRCQPLRQRRSPAERPCQPYFFHPQKQAPALPTLPPRDLSVRLRTLPSHLPPDPEYHSAAPRY*QPNYPPTPPSRPFL*I*YHY
RRWLLLLVLPRPVDPRSPTQSPEEVRKCKFQEPWKFLKCYRQKSDMHPSWIMIIGIVNILACTLISFVIYPCFDFGWNSPEALYLPPEP
DTPPQQQPQAHALPPPQPRPQYMPILDYEAEPQRPMLPAISYFNLTGGDD*PTGQ*QRQRPSPGHGRPRLGAATRPTSHSSAAGE
SRQGAAGRHSHPPVQERHLLPGETGQDLLRGHPDRPSPLLRAPAAAPEVHLPGRSQPHRHHPAVGRYQGVHPLLLRLPRLRPHSD
QDPLRPPRPPPHELITPLSSEIKIILMMI*IKKIII*FEIKIQSY**FEFNKNKESLT*NLIPGLCPCFLPTPPHSPLPSSGTAGPGGLQTSSTR
*RGCQIPPVPQSSFYLLSDVQKARPGG**LRPRLPLRCRQRTDRALHQPPLRLFRWIPREAPGGVVPATG*PRHHQERGNHPQAGR
GGGPRLVGKTHLQHGHQGRRPSQYFKQHHFP*NCCPFLQQQWNFKPQCLHTISSISHI*HFRHKSWKRSSDFK*VVDCTTNSSSYI
QLK*HHSKNRQRAIY*LQWKQRT*G*YKPKKRTSF*R*CYCNIYWKWLRLWIL***WKNKTRNYQNWSRIKF*C*QSNSCQTRHR
FKF*LRWCLDSWKQTG*QANTLDYP*PKP*LSITFRQRCQIYSLSYKMR*SNTRHCGSSGGCYCRISTKSN**HSQKRHSFP*I*FRWC
THVKLINGR*LLEL*GGTDHSKCSLYKCCGIHAKYRCISKNPK*NT*K*HSQSGIFNWRNYYANDTNHNFQWH**KRHNPS*HLLYD
FYMAVDWRL*GQKYYLCYQLILFFLHRPGIIPPSKPTPFPTTFVYMETLKQKNKVQVFY*INSFTGLEQLFFLHPPRTWNTPPSPPAQP
*TSECHW*WTCFWSPRSTQFQSEPVSDRSGR*NPPGTPASAPHSSTAEDCPRWSGSRLSGRSRRAAVGIIVRERDRPVVSHQAPQ
QSLPPPLRQAAAQGVRVQGLPQHDAHGPQHQSSGAAGAAAHANLAQVTAVRATQDHQVVQQSIVQHAPAETHRGKDATHVA
VVPDPQVNQVALPPEDAAHVHDLLGHVAVHHLPVPHHPLVEHAAPDDPAEPQGQHRPARHAAKRPRIPAMTMEDPPLVPVDHL
GAEQVYVGTAQAYAHASLQHSQLLGGQNHIPGHGELLQDSEPRRTGQSSHITYIVHGQGIAIRQHRVILHQRSAGLGLLTAW*GGR
PIRVMAGRG*SCSRPCHDAVAFGHFRTCCSRTWSGRCTPIAGGGLGAWNARC*SCKTATLSDRAADLGPQERSHHAL*SHR
PPWNGPGPAR*CNFVGFR*RRGREEQEEP*LTFNPNGLGALQNEGHGDGTSRPRCVGGK*QPGQR*YGSRDVPRWLPAKPPRA
HPETRQ*RKREGSLIPQPSCYTPAPSPDNFHFSSLE*FELVPEVNPSQP**KARAEHPPPAFLSTPS*FQDILLLVHLQQIDKRNIKISAA
IPELLPQQ*L*VLFHIVSEIFSHRTPRNKRRASHITDKPKSPPVSIAKCKIEISMLARPGDIFQITGQKIG*AIFKKINKRKIFQVHV*GLGN
NDGVSARGAFQHG*LADL*KNKK*NIKPC*PGEQVGKSFSPAPGRPRGLRRDPRKNCRYD*KPSQRDVPGGRRE*FEKKHTPPEH
WSP*VKKSGRGSNEALQRSLSSPAKRCHADEAQNFQVRKKCNYSPPAQAAKLPIPPDTHTKPQRP*LTERQQQRHTTGARVREKTE
L*PVRPLSAQYIAPDLH*RKGQSLKIPAK*SHTPSTRPETGDTLRKIRALPQTAKLPSFPGSHATSSKHDFQIPSTVKNITRPAPNGRRS
RSQSPSSLPKFKQLICILTRTKSLRYIIDD

Fig. 21A

AdC6 010-HIVgag (E1026) Nucleic Acids – SEQ ID NO: 2

```
CATCATCAATAATATACCTCAAACTTTTGGTGCGCGTTAATATGCAAATGAGCTGTTTGAATTTGGGGAGGGAGGAAGGTGAT
TGGCTGCGGGAGCGGCGACCGTTAGGGGCGGGGCGGGTGACGTTTTGATGACGTGGCTATGAGGCGGAGCCGGTTTGCAAG
TTCTCGTGGGAAAAGTGACGTCAAACGAGGTGTGGTTTGAACACGGAAATACTCAATTTTCCCGCGCTCTCTGACAGGAAATG
AGGTGTTTCTGGGCGGATGCAAGTGAAAACGGGCCATTTTCGCGCGAAAACTGAATGAGGAAGTGAAAATCTGAGTAATTTC
GCGTTTATGGCAGGGAGGAGTATTTGCCGAGGGCCGAGTAGACTTTGACCGATTACGTGGGGGTTTCGATTACCGTATTTTTC
ACCTAAATTTCCGCGTACGGTGTCAAAGTCCGGTGTTTTTACGTACGATATCATTTCCCCGAAAGTGCCACCTGACCGTAACTAT
AACGGTCCTAAGGTAGCGAAAGCTCAGATCTCCCGATCCCTATGGTGCACTCTCAGTACAATCTGCTCTGATGCCGCATAGTT
AAGCCAGTATCTGCTCCCTGCTTGTGTGTTGGAGGTCGCTGAGTAGTGCGCGAGCAAAATTTAAGCTACAACAAGGCAAGGCT
TGACCGACAATTGCATGAAGAATCTGCTTAGGGTTAGGCGTTTTGCGCTGCTTCGCGATGTACGGGCCAGATATACGCGTTGA
CATTGATTATTGACTAGTTATTAATAGTAATCAATTACGGGGTCATTAGTTCATAGCCCATATATGGAGTTCCGCGTTACATAAC
TTACGGTAAATGGCCCGCCTGGCTGACCGCCCAACGACCCCCGCCCATTGACGTCAATAATGACGTATGTTCCCATAGTAACGC
CAATAGGGACTTTCCATTGACGTCAATGGGTGGAGTATTTACGGTAAACTGCCCACTTGGCAGTACATCAAGTGTATCATATGC
CAAGTACGCCCCCTATTGACGTCAATGACGGTAAATGGCCCGCCTGGCATTATGCCCAGTACATGACCTTATGGGACTTTCCTA
CTTGGCAGTACATCTACGTATTAGTCATCGCTATTACCATGGTGATGCGGTTTTGGCAGTACATCAATGGGCGTGGATAGCGGT
TTGACTCACGGGGATTTCCAAGTCTCCACCCCATTGACGTCAATGGGAGTTTGTTTTGGCACCAAAATCAACGGGACTTTCCAA
AATGTCGTAACAACTCCGCCCCATTGACGCAAATGGGCGGTAGGCGTGTACGGTGGAGGTCTATATAAGCAGAGCTCGTTTA
GTGAACCGTCAGATCACTAGAAGCTTTATTGCGGTAGTTTATCACAGTTAAATTGCTAACGCAGTCAGTGCTTCTGACACAACA
GTCTCGAACTTAAGCTGCAGAAGTTGGTCGTGAGGCACTGGGCAGGTAAGTATCAAGGTTACAAGACAGGTTTAAGGAGACC
AATAGAAACTGGGCTTGTCGAGACAGAGAAGACTCTTGCGTTTCTGATAGGCACCTATTGGTCTTACTGACATCCACTTTGCCT
TTCTCTCCACAGGTGTCCACTCCCAGTTCAATTACAGCTCTTAAGGCTAGAGTACTTAATACGACTCACTATAGGCTAGCGCCAC
CATGGGCGCCAGAGCCAGCGTGCTGAGCGGGGAGAGCTGGATCGCTGGGAAAAGATTAGACTGAGGCCCGGAGGGAAGA
AAAAGTACAAGCTGAAACACATCGTGTGGGCCAGCAGGGAGCTGGAGCGCTTCGCCGTGAACCCCGGACTGCTGGAGACCTC
CGAAGGCTGTCGGCAGATCCTGGGGCAGCTGCAGCCTTCCCTGCAGACAGGCTCCGAGGAGCTGCGGTCTCTGTATAATACA
GTGGCCACACTGTACTGTGTGCACCAGCGGATTGAGGTGAAGGATACAAAAGAGGCCCTGGAGAAGATTGAGGAGGAGCAG
AACAAGAGCAAGAAGAAAGCCCAGCAGGCCGCCGCCGACACCGGCAATAGCTCCCAGGTGAGCCAGAACTATCCAATTGTGC
AGAATCTGCAGGGCCAGATGGTGCACCAGGCCATTTCCCCACGGACACTGAACGCCTGGGTGAAGGTGGTGGAGGAGAAGG
CCTTCAGCCCCGAAGTGATCCCTATGTTTTCCGCCCTGTCCGAAGGCGCCACCCCTCAGGACCTGAACACCATGCTGAACACAG
TGGGGGGACACCAGGCCGCCATGCAGATGCTGAAGGAAACCATCAACGAGGAGGCCGCCGAGTGGGATCGGCTGCACCCCG
TGCACGCCGGGCCAATCGCCCCTGGCCAGATGAGGGAGCCCAGAGGCTCTGACATCGCCGGCACCACATCTACCCTGCAGGA
ACAGATCGGGTGGATGACCAATAACCCACCAATCCCAGTGGGCGAGATCTACAAGAGGTGGATTATTCTGGGACTGAACAAA
ATTGTGCGCATGTATTCCCCTACATCCATCCTGGACATCAGGCAGGGCCCTAAGGAACCTTTCCGCGACTACGTGGATCGGTTC
TACAAAACCCTGCGCGCCGAGCAGGCCAGCCAGGAAGTGAAGAATTGGATGACAGAGACCCTGCTGGTGCAGAACGCCAATC
CTGACTGTAAAACCATCCTGAAGGCCCTGGGCCCTGCCGCCACACTGGAGGAAATGATGACCGCCTGCCAGGGCGTGGGCGG
CCCTGGCCACAAAGCCAGGGTGCTGGCCGAGGCCATGTCTCAGGTGACCAACTCTGCCACAATTATGATGCAGCGGGGGAAC
TTTCGGAACCAGAGGAAGACCGTGAAGTGCTTCAACTGTGGCAAGGAGGGACACATCGCCAAGAATTGCCGCGCCCCACGGA
AGAAGGGGTGTTGGAAATGCGGGAAGGAGGGCCACCAGATGAAAGACTGCACAGAGCGGCAGGCCAACTTTCTGGGCAAG
ATTTGGCCCAGCCACAAGGGCCGCCCCGGAAACTTTCTGCAGTCCAGGCCTGAGCCTACCGCCCCCCCTGAGGAATCCTTCCG
GTTCGGCGAGGAGACAACCACCCCAAGCCAGAAGCAGGAACCCATCGACAAAGAGCTGTACCCCCTGGCCAGCCTGAGATCC
CTGTTCGGGAATGACCCCAGCTCTCAGTGATGATCTAGCGTTTAAACGGGCCCTCTAGAGTCGACCCGGGCGGCCAAACCGCT
GATCAGCCTCGACTGTGCCTTCTAGTTGCCAGCCATCTGTTGTTTGCCCCTCCCCCGTGCCTTCCTTGACCCTGGAAGGTGCCAC
TCCCACTGTCCTTTCCTAATAAAATGAGGAAATTGCATCGCATTGTCTGAGTAGGTGTCATTCTATTCTGGGGGGTGGGGTGGG
GCAGGACAAGGGGGAGGATTGGGAAGACAATAGCAGGCATGCTGGGGATGCGGTGGGCTCTATGGCTTCTGAGGCGG
AAAGAACCAGCAGATCTGCAGATCTGAATTCATCTATGTCGGGTGCGGAGAAGAGGGTAATGAAATGGTATTATGGGTATTAT
GGGTCTGCATTAATGAATCGGTCAGATATCGACATATGCTGGCCACCGTGCATGTGGCCTCGCACCCCCGCAAGACATGGCCC
GAGTTCGAGCACAACGTCATGACCCGCTGCAATGTGCACCTGGGCTCCCGCCGAGGCATGTTCATGCCCTACCAGTGCAACAT
GCAATTTGTGAAGGTGCTGCTGGAGCCCGATGCCATGTCCAGAGTGAGCCTGACGGGGGTGTTTGACATGAATGTGGAGCTG
TGGAAAATTCTGAGATATGATGAATCCAAGACCAGGTGCCGGGCCTGCGAATGCGGAGGCAAGCACGCCAGGCTTCAGCCCG
TGTGTGTGGAGGTGACGGAGGACCTGCGACCCGATCATTTGGTGTTGTCCTGCAACGGGACGGAGTTCGGCTCCAGCGGGGA
```

Fig. 21B

```
AGAATCTGACTAGAGTGAGTAGTGTTTGGGGCTGGGTGTGAGCCTGCATGAGGGGCAGAATGACTAAAATCTGTGGTTTTCT
GTGTGTTGCAGCAGCATGAGCGGAAGCGCCTCCTTTGAGGGAGGGGTATTCAGCCCTTATCTGACGGGGCGTCTCCCCTCCTG
GGCGGGAGTGCGTCAGAATGTGATGGGATCCACGGTGGACGGCCGGCCCGTGCAGCCCGCGAACTCTTCAACCCTGACCTAC
GCGACCCTGAGCTCCTCGTCCGTGGACGCAGCTGCCGCCGCAGCTGCTGCTTCCGCCGCCAGCGCCGTGCGCGGAATGGCCCT
GGGCGCCGGCTACTACAGCTCTCTGGTGGCCAACTCGAGTTCCACCAATAATCCCGCCAGCCTGAACGAGGAGAAGCTGCTGC
TGCTGATGGCCCAGCTCGAGGCCCTGACCCAGCGCCTGGGCGAGCTGACCCAGCAGGTGGCTCAGCTGCAGGCGGAGACGC
GGGCCGCGGTTGCCACGGTGAAAACCAAATAAAAAATGAATCAATAAATAAACGGAGACGGTTGTTGATTTTAACACAGAGT
CTTGAATCTTTATTTGATTTTTCGCGCGCGGTAGGCCCTGGACCACCGGTCTCGATCATTGAGCACCCGGTGGATCTTTTCCAG
GACCCGGTAGAGGTGGGCTTGGATGTTGAGGTACATGGGCATGAGCCCGTCCCGGGGGTGGAGGTAGCTCCATTGCAGGGC
CTCGTGCTCGGGGATGGTGTTGTAAATCACCCAGTCATAGCAGGGGCGCAGGGCGTGGTGCTGCACGATGTCCTTGAGGAGG
AGACTGATGGCCACGGGCAGCCCCTTGGTGTAGGTGTTGACGAACCTGTTGAGCTGGGAGGGATGCATGCGGGGGGAGATG
AGATGCATCTTGGCCTGGATCTTGAGATTGGCGATGTTCCCGCCCAGATCCCGCCGGGGGTTCATGTTGTGCAGGACCACCAG
CACGGTGTATCCGGTGCACTTGGGGAATTTGTCATGCAACTTGGAAGGGAAGGCGTGAAAGAATTTGGAGACGCCCTTGTGA
CCGCCCAGGTTTTCCATGCACTCATCCATGATGATGGCGATGGGCCCGTGGGCGGCGGCCTGGGCAAAGACGTTTCGGGGGT
CGGACACATCGTAGTTGTGGTCCTGGGTGAGCTCGTCATAGGCCATTTTAATGAATTTGGGGCGGAGGGTGCCCGACTGGGG
GACGAAGGTGCCCTCGATCCCGGGGGCGTAGTTGCCCTCGCAGATCTGCATCTCCCAGGCCTTGAGCTCGGAGGGGGGGATC
ATGTCCACCTGCGGGGCGATGAAAAAAACGGTTTCCGGGGCGGGGGAGATGAGCTGGGCCGAAAGCAGGTTCCGGAGCAGC
TGGGACTTGCCGCAACCGGTGGGGCCGTAGATGACCCCGATGACCGGCTGCAGGTGGTAGTTGAGGGAGAGACAGCTGCCG
TCCTCGCGGAGGAGGGGGGCCACCTCGTTCATCATCTCGCGCACATGCATGTTCTCGCGCACGAGTTCCGCCAGGAGGCGCTC
GCCCCCCAGCGAGAGGAGCTCTTGCAGCGAGGCGAAGTTTTTCAGCGGCTTGAGTCCGTCGGCCATGGGCATTTTGGAGAGG
GTCTGTTGCAAGAGTTCCAGACGGTCCCAGAGCTCGGTGATGTGCTCTAGGGCATCTCGATCCAGCAGACCTCCTCGTTTCGC
GGGTTGGGGCGACTGCGGGAGTAGGGCACCAGGCGATGGGCGTCCAGCGAGGCCAGGGTCCGGTCCTTCCAGGGCCGCAG
GGTCCGCGTCAGCGTGGTCTCCGTCACGGTGAAGGGGTGCGCGCCGGGCTGGGCGCTTGCGAGGGTGCGCTTCAGGCTCATC
CGGCTGGTCGAGAACCGCTCCCGGTCGGCGCCCTGCGCGTCGGCCAGGTAGCAATTGAGCATGAGTTCGTAGTTGAGCGCCT
CGGCCGCGTGGCCCTTGGCGCGGAGCTTACCTTTGGAAGTGTGTCCGCAGACGGGACAGAGGAGGGACTTGAGGGCGTAGA
GCTTGGGGGCGAGGAAGACGGACTCGGGGCGTAGGCGTCCGCGCCGCAGCTGGCGCAGACGGTCTCGCACTCCACGAGCC
AGGTGAGGTCGGGGCGGTTGGGGTCAAAAACGAGGTTTCCTCCGTGCTTTTTGATGCGTTTCTTACCTCTGGTCTCCATGAGCT
CGTGTCCCCGCTGGGTGACAAAGAGGCTGTCCGTGTCCCCGTAGACCGACTTTATGGGCCGGTCCTCGAGCGGGGTGCCGCG
GTCCTCGTCGTAGAGGAACCCCGCCCACTCCGAGACGAAGGCCCGGGTCCAGGCCAGCACGAAGGAGGCCACGTGGGAGGG
GTAGCGGTCGTTGTCCACCAGCGGGTCCACCTTCTCCAGGGTATGCAAGCACATGTCCCCCTCGTCCACATCCAGGAAGGTGA
TTGGCTTGTAAGTGTAGGCCACGTGACCGGGGGTCCCGGCCGGGGGGTATAAAAGGGGGCGGGCCCCTGCTCGTCCTCACT
GTCTTCCGGATCGCTGTCCAGGAGCGCCAGCTGTTGGGGTAGGTATTCCCTCTCGAAGGCGGGCATGACCTCGGCACTCAGGT
TGTCAGTTTCTAGAAACGAGGAGGATTTGATATTGACGGTGCCGTTGGAGACGCCTTTCATGAGCCCCTCGTCCATTTGGTCAG
AAAAGACGATCTTTTTGTTGTCGAGCTTGGTGGCGAAGGAGCCGTAGAGGGCGTTGGAGAGCAGCTTGGCGATGGAGCGCAT
GGTCTGGTTCTTTTCCTTGTCGGCGCGCTCCTTGGCGGCGATGTTGAGCTGCACGTACTCGCGCGCCACGCACTTCCATTCGGG
GAAGACGGTGGTGAGCTCGTCGGGCACGATTCTGACCCGCCAGCCGCGGTTGTGCAGGGTGATGAGGTCCACGCTGGTGGC
CACCTCGCCGCGCAGGGGCTCGTTGGTCCAGCAGAGGCGCCCGCCCTTGCGCGAGCAGAAGGGGGGCAGCGGGTCCAGCAT
GAGCTCGTCGGGGGGTCGGCGTCCACGGTGAAGATGCCGGGCAGGAGCTCGGGGTCGAAGTAGCTGATGCAGGTGCCCA
GATTGTCCAGCGCCGCTTGCCAGTCGCGCACGGCCAGCGCGCGCTCGTAGGGGCTGAGGGGCGTGCCCCAGGGCATGGGGT
GCGTGAGCGCGGAGGCGTACATGCCGCAGATGTCGTAGACGTAGAGGGGCTCCTCGAGGACGCCGATGTAGGTGGGGTAGC
AGCGCCCCCGCGGATGCTGGCGCGCACGTAGTCGTACAGCTCGTGCGAGGGCGCGAGGAGCCCCGTGCCGAGGTTGGAGC
GTTGCGGCTTTTCGGCGCGGTAGACGATCTGGCGGAAGATGGCGTGGGAGTTGGAGGAGATGGTGGGCCTTTGGAAGATGT
TGAAGTGGGCGTGGGGCAGGCCGACCGAGTCCCTGATGAAGTGGGCGTAGGAGTCCTGCAGCTTGGCGACGAGCTCGGCGG
TGACGAGGACGTCCAGGGCGCAGTAGTCGAGGGTCTCTTGGATGATGTCATACTTGAGCTGGCCCTTCTGCTTCCACAGCTCG
CGGTTGAGAAGGAACTCTTCGCGGTCCTTCCAGTACTCTTCGAGGGGGAACCCGTCCTGATCGGCACGGTAAGAGCCCACCAT
GTAGAACTGGTTGACGGCCTTGTAGGCGCAGCAGCCCTTCTCCACGGGGAGGGCGTAAGCTTGCGCGGCCTTGCGCAGGGAG
GTGTGGGTGAGGGCGAAGGTGTCGCGCACCATGACCTTGAGGAACTGGTGCTTGAAGTCGAGGTCGTCGCAGCCGCCCTGCT
CCCAGAGTTGGAAGTCCGTGCGCTTCTTGTAGGCGGGGTTAGGCAAAGCGAAAGTAACATCGTTGAAGAGGATCTTGCCCGC
GCGGGGCATGAAGTTGCGAGTGATGCGGAAAGGCTGGGGCACCTCGGCCCGGTTGTTGATGACCTGGGCGGCGAGGACGAT
CTCGTCGAAGCCGTTGATGTTGTGCCCGACGATGTAGAGTTCCACGAATCGCGGGCGGCCCTTGACGTGGGGCAGCTTCTTGA
```

Fig. 21C

GCTCGTCGTAGGTGAGCTCGGCGGGGTCGCTGAGCCCGTGCTGCTCGAGGGCCCAGTCGGCGACGTGGGGGTTGGCGCTGA
GGAAGGAAGTCCAGAGATCCACGGCCAGGGCGGTCTGCAAGCGGTCCCGGTACTGACGGAACTGTTGGCCCACGGCCATTTT
TTCGGGGGTGACGCAGTAGAAGGTGCGGGGGTCGCCGTGCCAGCGGTCCCACTTGAGCTGGAGGGCGAGGTCGTGGGCGA
GCTCGACGAGCGGCGGGTCCCCGGAGAGTTTCATGACCAGCATGAAGGGGACGAGCTGCTTGCCGAAGGACCCCATCCAGGT
GTAGGTTTCCACATCGTAGGTGAGGAAGAGCCTTTCGGTGCGAGGATGCGAGCCGATGGGGAAGAACTGGATCTCCTGCCAC
CAGTTGGAGGAATGGCTGTTGATGTGATGGAAGTAGAAATGCCGACGGCGCGCCGAGCACTCGTGCTTGTGTTTATACAAGC
GTCCGCAGTGCTCGCAACGCTGCACGGGATGCACGTGCTGCACGAGCTGTACCTGGGTTCCTTTGGCGAGGAATTTCAGTGG
GCAGTGGAGCGCTGGCGGCTGCATCTCGTGCTGTACTACGTCTTGGCCATCGGCGTGGCCATCGTCTGCCTCGATGGTGGTCA
TGCTGACGAGCCCGCGCGGGAGGCAGGTCCAGACCTCGGCTCGGACGGGTCGGAGAGCGAGGACGAGGGCGCGCAGGCCG
GAGCTGTCCAGGGTCCTGAGACGCTGCGGAGTCAGGTCAGTGGGCAGCGGCGGCGCGCGGTTGACTTGCAGGAGCTTTTCCA
GGGCGCGCGGGAGGTCCAGATGGTACTTGATCTCCACGGCGCCGTTGGTGGCTACGTCCACGGCTTGCAGGGTGCCGTGCCC
CTGGGGCGCCACCACCGTGCCCCGTTTCTTCTTGGGCGCTGCTTCCATGTCGGTCAGAAGCGGCGGCGAGGACGCGCGCCGG
GCGGCAGGGCGGCTCGGGCCCGGAGGCAGGGCGGCAGGGGCACGTCGGCGCCGCGCGGGCAGGTTCTGGTACTGC
GCCCGGAGAAGACTGGCGTGAGCGACGACGCGACGGTTGACGTCCTGGATCTGACGCCTCTGGGTGAAGGCCACGGGACCC
GTGAGTTTGAACCTGAAAGAGAGTTCGACAGAATCAATCTCGGTATCGTTGACGGCGGCCTGCCGCAGGATCTCTTGCACGTC
GCCCGAGTTGTCCTGGTAGGCGATCTCGGTCATGAACTGCTCGATCTCCTCCTCCTGAAGGTCTCCGCGGCCGGCGCGCTCGA
CGGTGGCCGCGAGGTCGTTGGAGATGCGGCCCATGAGCTGCGAGAAGGCGTTCATGCCGGCCTCGTTCCAGACGCGGCTGTA
GACCACGGCTCCGTCGGGGTCGCGCGCGCGCATGACCACCTGGGCGAGGTTGAGCTCGACGTGGCGCGTGAAGACCGCGTA
GTTGCAGAGGCGCTGGTAGAGGTAGTTGAGCGTGGTGGCGATGTGCTCGGTGACGAAGAAGTACATGATCCAGCGGCGGAG
CGGCATCTCGCTGACGTCGCCCAGGGCTTCCAAGCGTTCCATGGCCTCGTAGAAGTCCACGGCGAAGTTGAAAAACTGGGAGT
TGCGCGCCGAGACGGTCAACTCCTCCTCCAGAAGACGGATGAGCTCGGCGATGGTGGCGCGCACCTCGCGCTCGAAGGCCCC
GGGGGGCTCCTCTTCCATCTCCTCCTCTTCCTCCTCCACTAACATCTCTTCTACTTCCTCCTCAGGAGGCGGTGGCGGGGGAGG
GGCCCTGCGTCGCCGGCGGCGCACGGGCAGACGGTCGATGAAGCGCTCGATGGTCTCCCCGCGCCGGCGACGCATGGTCTCG
GTGACGGCGCGCCCGTCCTCGCGGGGCCGCAGCATGAAGACGCCGCCGCGCATCTCCAGGTGGCCGCCGGGGGGTCTCCG
TTGGGCAGGGAGAGGGCGCTGACGATGCATCTTATCAATTGACCCGTAGGGACTCCGCGCAAGGACCTGAGCGTCTCGAGAT
CCACGGGATCCGAAAACCGCTGAACGAAGGCTTCGAGCCAGTCGCAGTCGCAAGGTAGGCTGAGCCCGGTTTCTTGTTCTTCG
GGTATTTGGTCGGGAGGCGGGCGGGCGATGCTGCTGGTGATGAAGTTGAAGTAGGCGGTCCTGAGACGGCGGATGGTGGC
GAGGAGCACCAGGTCCTTGGGCCCGGCTTGCTGGATGCGCAGACGGTCGGCCATGCCCCAGGCGTGGTCCTGACACCTGGCG
AGGTCCTTGTAGTAGTCCTGCATGAGCCGCTCCACGGGCACCTCCTCCTCGCCCGCGCGGCCGTGCATGCGCGTGAGCCCGAA
CCCGCGCTGCGGCTGGACGAGCGCCAGGTCGGCGACGACGCGCTCGGTGAGGATGGCCTGCTGGATCTGGGTGAGGGTGGT
CTGGAAGTCGTCGAAGTCGACGAAGCGGTGGTAGGCTCCGGTGTTGATGGTGTAGGAGCAGTTGGCCATGACGGACCAGTT
GACGGTCTGGTGGCCGGGTCGCACGAGCTCGTGGTACTTGAGGCGCGAGTAGGCGCGCGTGTCGAAGATGTAGTCGTTGCA
GGCGCGCACGAGGTACTGGTATCCGACGAGGAAGTGCGGCGGCGGCTGGCGGTAGAGCGGCCATCGCTCGGTGGCGGGGG
CGCCGGGCGCGAGGTCCTCGAGCATGAGGCGGTGGTAGCCGTAGATGTACCTGGACATCCAGGTGATGCCGGCGGCGGTGG
TGGAGGCGCGCGGGAACTCGCGGACGCGGTTCCAGATGTTGCGCAGCGGCAGGAAGTAGTTCATGGTGGCCGCGGTCTGGC
CCGTGAGGCGCGCGCAGTCGTGGATGCTCTAGACATACGGGCAAAAACGAAAGCGGTCAGCGGCTCGACTCCGTGGCCTGG
AGGCTAAGCGAACGGGTTGGGCTGCGCGTGTACCCCGGTTCGAATCTCGAATCAGGCTGGAGCCGCAGCTAACGTGGTACTG
GCACTCCCGTCTCGACCCAAGCCTGCTAACGAAACCTCCAGGATACGGAGGCGGGTCGTTTTTTGGCCTTGGTCGCTGGTCAT
GAAAAACTAGTAAGCGCGGAAAGCGGCCGCCCGCGATGGCTCGCTGCCGTAGTCTGGAGAAAGAATCGCCAGGGTTGCGTT
GCGGTGTGCCCCGGTTCGAGCCTCAGCGCTCGGCGCCGGCCGGATTCCGCGGCTAACGTGGGCGTGGCTGCCCCGTCGTTTCC
AAGACCCCTTAGCCAGCCGACTTCTCCAGTTACGGAGCGAGCCCCTCTTTTTTTTTTCTTGTGTTTTTGCCAGATGCATCCCGTACT
GCGGCAGATGCGCCCCCACCCTCCACCACAACCGCCCCTACCGCAGCAGCAGCAACAGCCGGCGCTTCTGCCCCCGCCCCAGC
AGCAGCCAGCCACTACCGCGGCGGCCGCCGTGAGCGGAGCCGGCGTTCAGTATGACCTGGCCTTGGAAGAGGGCGAGGGGC
TGGCGCGGCTGGGGGCGTCGTCGCCGGAGCGGCACCCGCGCGTGCAGATGAAAAGGGACGCTCGCGAGGCCTACGTGCCCA
AGCAGAACCTGTTCAGAGACAGGAGCGGCGAGGAGCCCGAGGAGATGCGCGCCTCCCGCTTCCACGCGGGGCGGAGCTGC
GGCGCGGCCTGGACCGAAAGCGGGTGCTGAGGGACGAGGATTTCGAGGCGGACGAGCTGACGGGATCAGCCCCGCGCGC
GCGCACGTGGCCGCGGCCAACCTGGTCACGGCGTACGAGCAGACCGTGAAGGAGGAGAGCAACTTCCAAAAATCCTTCAACA
ACCACGTGCGCACCTTGATCGCGCGCGAGGAGGTGACCCTGGGCCTGATGCACCTGTGGGACCTGCTGGAGGCCATCGTGCA
GAACCCCACGAGCAAGCCGCTGACGGCGCAGCTGTTTCTGGTGGTGCAGCACAGTCGGGACAACGAGACGTTCAGGGAGGC
GCTGCTGAATATCACCGAGCCCGAGGGCCGCTGGCTCCTGGACCTGGTGAACATTTTGCAGAGCATCGTGGTGCAGGAGCGC

Fig. 21D

```
GGGCTGCCGCTGTCCGAGAAGCTGGCGGCCATCAACTTCTCGGTGCTGAGTCTGGGCAAGTACTACGCTAGGAAGATCTACA
AGACCCCGTACGTGCCCATAGACAAGGAGGTGAAGATCGACGGGTTTTACATGCGCATGACCCTGAAAGTGCTGACCCTGAG
CGACGATCTGGGGGTGTACCGCAACGACAGGATGCACCGCGCGGTGAGCGCCAGCCGCCGGCGCGAGCTGAGCGACCAGGA
GCTGATGCACAGCCTGCAGCGGGCCCTGACCGGGGCCGGGACCGAGGGGGAGAGCTACTTTGACATGGGCGCGGACCTGCG
CTGGCAGCCCAGCCGCCGGGCCTTGGAAGCTGCCGGCGGTTCCCCCTACGTGGAGGAGGTGGACGATGAGGAGGAGGAGG
GCGAGTACCTGGAAGACTGATGGCGCGACCGTATTTTTGCTAGATGCAGCAACAGCCACCGCCGCCGCCTCCTGATCCCGCGA
TGCGGGCGGCGCTGCAGAGCCAGCCGTCCGGCATTAACTCCTCGGACGATTGGACCCAGGCCATGCAACGCATCATGGCGCT
GACGACCCGCAATCCCGAAGCCTTTAGACAGCAGCCTCAGGCCAACCGGCTCTCGGCCATCCTGGAGGCCGTGGTGCCCTCGC
GCTCGAACCCCACGCACGAGAAGGTGCTGGCCATCGTGAACGCGCTGGTGGAGAACAAGGCCATCCGCGGTGACGAGGCCG
GGCTGGTGTACAACGCGCTGCTGGAGCGCGTGGCCCGCTACAACAGCACCAACGTGCAGACGAACCTGGACCGCATGGTGAC
CGACGTGCGCGAGGCGGTGTCGCAGCGCGAGCGGTTCCACCGCGAGTCGAACCTGGGCTCCATGGTGGCGCTGAACGCCTTC
CTGAGCACGCAGCCCGCCAACGTGCCCCGGGGCCAGGAGGACTACACCAACTTCATCAGCGCGCTGCGGCTGATGGTGGCCG
AGGTGCCCCAGAGCGAGGTGTACCAGTCGGGGCCGGACTACTTCTTCCAGACCAGTCGCCAGGGCTTGCAGACCGTGAACCT
GAGCCAGGCTTTCAAGAACTTGCAGGGACTGTGGGGCGTGCAGGCCCCGGTCGGGGACCGCGCGACGGTGTCGAGCCTGCT
GACGCCGAACTCGCGCCTGCTGCTGCTGCTGGTGGCGCCCTTCACGGACAGCGGCAGCGTGAGCCGCGACTCGTACCTGGGC
TACCTGCTTAACCTGTACCGCGAGGCCATCGGACAGGCGCACGTGGACGAGCAGACCTACCAGGAGATCACCCACGTGAGCC
GCGCGCTGGGCCAGGAGGACCCGGGCAACCTGGAGGCCACCCTGAACTTCCTGCTGACCAACCGGTCGCAGAAGATCCCGCC
CCAGTACGCGCTGAGCACCGAGGAGGAGCGCATCCTGCGCTACGTGCAGCAGAGCGTGGGGCTGTTCCTGATGCAGGAGGG
GGCCACGCCCAGCGCGGCGCTCGACATGACCGCGCGCAACATGGAGCCCAGCATGTACGCCCGCAACCGCCCGTTCATCAAT
AAGCTGATGGACTACTTGCATCGGGCGGCCGCCATGAACTCGGACTACTTTACCAACGCCATCTTGAACCCGCACTGGCTCCCG
CCGCCCGGGTTCTACACGGGCGAGTACGACATGCCCGACCCCAACGACGGGTTCCTGTGGGACGACGTGGACAGCAGCGTGT
TCTCGCCGCGTCCAGGAACCAATGCCGTGTGGAAGAAAGAGGGCGGGGACCGGCGGCCGTCCTCGGCGCTGTCCGGTCGCG
CGGGTGCTGCCGCGGCGGTGCCCGAGGCCGCCAGCCCCTTCCCGAGCCTGCCCTTTTCGCTGAACAGCGTGCGCAGCAGCGA
GCTGGGTCGGCTGACGCGACCGCGCCTGCTGGGCGAGGAGGAGTACCTGAACGACTCCTTGTTGAGGCCCGAGCGCGAGAA
GAACTTCCCCAATAACGGGATAGAGAGCCTGGTGGACAAGATGAGCCGCTGGAAGACGTACGCGCACGAGCACAGGGACGA
GCCCCGAGCTAGCAGCGCAGGCACCCGTAGACGCCAGCGGCACGACAGGCAGCGGGGACTGGTGTGGGACGATGAGGATTC
CGCCGACGACAGCAGCGTGTTGGACTTGGGTGGGAGTGGTGGTAACCCGTTCGCTCACCTGCGCCCCCGTATCGGGCGCCTG
ATGTAAGAATCTGAAAAAATAAAAGACGGTACTCACCAAGGCCATGGCGACCAGCGTGCGTTCTTCTCTGTTGTTTGTAGTAG
TATGATGAGGCGCGTGTACCCGGAGGGTCCTCCTCCCTCGTACGAGAGCGTGATGCAGCAGGCGGTGGCGGCGGCGATGCA
GCCCCCGCTGGAGGCGCCTTACGTGCCCCGCGGTACCTGGCGCCTACGGAGGGGCGGAACAGCATTCGTTACTCGGAGCTG
GCACCCTTGTACGATACCACCCGGTTGTACCTGGTGGACAACAAGTCGGCAGACATCGCCTCGCTGAACTACCAGAACGACCA
CAGCAACTTCCTGACCACCGTGGTGCAGAACAACGATTTCACCCCCACGGAGGCCAGCACCCAGACCATCAACTTTGACGAGC
GCTCGCGGTGGGGCGGCCAGCTGAAAACCATCATGCACACCAACATGCCCAACGTGAACGAGTTCATGTACAGCAACAAGTTC
AAGGCGCGGGTGATGGTCTCGCGCAAGACCCCCAACGGGGTGGATGATGATTATGATGGTAGTCAGGACGAGCTGACCTAC
GAGTGGGTGGAGTTTGAGCTGCCCGAGGGCAACTTCTCGGTGACCATGACCATCGATCTGATGAACAACGCCATCATCGACAA
CTACTTGGCGGTGGGGCGGCAGAACGGGGTGCTGGAGAGCGACATCGGCGTGAAGTTCGACACGCGCAACTTCCGGCTGGG
CTGGGACCCCGTGACCGAGCTGGTGATGCCGGGCGTGTACACCAACGAGGCCTTCCACCCCGACATCGTCCTGCTGCCCGGCT
GCGGCGTGGACTTCACCGAGAGCCGCCTCAGCAACCTGCTGGGCATCCGCAAGCGGCAGCCCTTCCAGGAGGGCTTCCAGAT
CCTGTACGAGGACCTGGAGGGGGGCAACATCCCCGCGCTCTTGGATGTCGAAGCCTACGAGAAAAGCAAGGAGGATAGCAC
CGCCGCGGCGACCGCAGCCGTGGCCACCGCCTCTACCGAGGTGCGGGGCGATAATTTTGCTAGCGCTGCGGCAGCGGCCGAG
GCGGCTGAAACCGAAAGTAAGATAGTCATCCAGCCGGTGGAGAAGGACAGCAAGGACAGGAGCTACAACGTGCTCGCGGAC
AAGAAAAACACCGCCTACCGCAGCTGGTACCTGGCCTACAACTACGGCGACCCCGAGAAGGGCGTGCGCTCCTGGACGCTGC
TCACCACCTCGGACGTCACCTGCGGCGTGGAGCAAGTCTACTGGTCGCTGCCCGACATGATGCAAGACCCGGTCACCTTCCGC
TCCACGCGTCAAGTTAGCAACTACCCGGTGGTGGGCGCCGAGCTCCTGCCCGTCTACTCCAAGAGCTTCTTCAACGAGCAGGC
CGTCTACTCGCAGCAGCTGCGCGCCTTCACCTCGCTCACGCACGTCTTCAACCGCTTCCCCGAGAACCAGATCCTCGTCCGCCC
GCCCGCGCCCACCATTACCACCGTCAGTGAAAACGTTCCTGCTCTCACAGATCACGGGACCCTGCCGCTGCGCAGCAGTATCCG
GGGAGTCCAGCGCGTGACCGTCACTGACGCCAGACGCCGCACCTGCCCCTACGTCTACAAGGCCCTGGGCGTAGTCGCGCCG
CGCGTCCTCTCGAGCCGCACCTTCTAAAAAATGTCCATTCTCATCTCGCCCAGTAATAACACCGGTTGGGGCCTGCGCGCGCCC
AGCAAGATGTACGGAGGCGCTCGCCAACGCTCCACGCAACACCCCGTGCGCGTGCGCGGGCACTTCCGCGCTCCCTGGGGCG
CCCTCAAGGGCCGCGTGCGCTCGCGCACCACCGTCGACGACGTGATCGACCAGGTGGTGGCCGACGCGCGCAACTACACGCC
```

Fig. 21E

CGCCGCCGCGCCCGTCTCCACCGTGGACGCCGTCATCGACAGCGTGGTGGCCGACGCGCGCCGGTACGCCCGCACCAAGAGC
CGGCGGCGGCGCATCGCCCGGCGGCACCGGAGCACCCCCGCCATGCGCGCGGCGCGAGCCTTGCTGCGCAGGGCCAGGCGC
ACGGGACGCAGGGCCATGCTCAGGGCGGCCAGACGCGCGGCCTCCGGCAGCAGCAGCGCCGGCAGGACCCGCAGACGCGC
GGCCACGGCGGCGGCGGCGGCCATCGCCAGCATGTCCCGCCCGCGGCGCGGCAACGTGTACTGGGTGCGCGACGCCGCCAC
CGGTGTGCGCGTGCCCGTGCGCACCCGCCCCCCTCGCACTTGAAGATGCTGACTTCGCGATGTTGATGTGTCCCAGCGGCGAG
GAGGATGTCCAAGCGCAAATACAAGGAAGAGATGCTCCAGGTCATCGCGCCTGAGATCTACGGCCCCGCGGCGGCGGTGAA
GGAGGAAAGAAAGCCCCGCAAACTGAAGCGGGTCAAAAAGGACAAAAAGGAGGAGGAAGATGACGGACTGGTGGAGTTTG
TGCGCGAGTTCGCCCCCCGGCGGCGCGTGCAGTGGCGCGGGCGGAAAGTGAAACCGGTGCTGCGGCCCGGCACCACGGTGG
TCTTCACGCCCGGCGAGCGTTCCGGCTCCGCCTCCAAGCGCTCCTACGACGAGGTGTACGGGGACGAGGACATCCTCGAGCA
GGCGGTCGAGCGTCTGGGCGAGTTTGCGTACGGCAAGCGCAGCCGCCCCGCGCCCTTGAAAGAGGAGGCGGTGTCCATCCC
GCTGGACCACGGCAACCCCACGCCGAGCCTGAAGCCGGTGACCCTGCAGCAGGTGCTACCGAGCGCGGCGCCGCGCCGGGG
CTTCAAGCGCGAGGGCGGCGAGGATCTGTACCCGACCATGCAGCTGATGGTGCCCAAGCGCCAGAAGCTGGAGGACGTGCT
GGAGCACATGAAGGTGGACCCCGAGGTGCAGCCCGAGGTCAAGGTGCGGCCCATCAAGCAGGTGGCCCCGGGCCTGGGCGT
GCAGACCGTGGACATCAAGATCCCCACGGAGCCCATGGAAACGCAGACCGAGCCCGTGAAGCCCAGCACCAGCACCATGGAG
GTGCAGACGGATCCCTGGATGCCAGCACCAGCTTCCACCAGCACTCGCCGAAGACGCAAGTACGGCGCGGCCAGCCTGCTGA
TGCCCAACTACGCGCTGCATCCTTCCATCATCCCCACGCCGGGCTACCGCGGCACGCGCTTCTACCGCGGCTACACCAGCAGCC
GCCGCCGCAAGACCACCACCCGCCGCCGTCGTCGCAGCCGCCGCAGCAGCACCGCGACTTCCGCCTTGGTGCGGAGAGTGTA
TCGCAGCGGGCGCGAGCCTCTGACCCTGCCGCGCGCGCGCTACCACCCGAGCATCGCCATTTAACTACGCCTCCTACTTGCAG
ATATGGCCCTCACATGCCGCCTCCGCGTCCCCATTACGGGCTACCGAGGAAGAAAGCCGCGCCGTAGAAGGCTGACGGGGAA
CGGGCTGCGTCGCCATCACCACCGGCGGCGGCGCGCCATCAGCAAGCGGTTGGGGGGAGGCTTCCTGCCCGCGCTGATCCCC
ATCATCGCCGCGGCGATCGGGGCGATCCCCGGCATAGCTTCCGTGGCGGTGCAGGCCTCTCAGCGCCACTGAGACACAAAAA
AGCATGGATTTGTAATAAAAAAAAAAATGGACTGACGCTCCTGGTCCTGTGATGTGTGTTTTTAGATGGAAGACATCAATTTTT
CGTCCCTGGCACCGCGACACGGCACGCGGCCGTTTATGGGCACCTGGAGCGACATCGGCAACAGCCAACTGAACGGGGGCGC
CTTCAATTGGAGCAGTCTCTGGAGCGGGCTTAAGAATTTCGGGTCCACGCTCAAAACCTATGGCAACAAGGCGTGGAACAGCA
GCACAGGGCAGGCGCTGAGGGAAAAGCTGAAAGAACAGAACTTCCAGCAGAAGGTGGTTGATGGCCTGGCCTCAGGCATCA
ACGGGGTGGTTGACCTGGCCAACCAGGCCGTGCAGAAACAGATCAACAGCCGCCTGGACGCGGTCCCGCCCGCGGGGTCCGT
GGAGATGCCCCAGGTGGAGGAGGAGCTGCCTCCCCTGGACAAGCGCGGCGACAAGCGACCGCGTCCCGACGCGGAGGAGA
CGCTGCTGACGCACACGGACGAGCCGCCCCGTACGAGGAGGCGGTGAAACTGGGCCTGCCCACCACGCGGCCCGTGGCGC
CTCTGGCCACCGGAGTGCTGAAACCCAGCAGCAGCCAGCCCGCGACCCTGGACTTGCCTCCGCCTCGCCCCTCCACAGTGGCT
AAGCCCCTGCCGCCGGTGGCCGTCGCGTCGCGCGCCCCCGAGGCCGCCCCCAGGCGAACTGGCAGAGCACTCTGAACAGCA
TCGTGGGTCTGGGAGTGCAGAGTGTGAAGCGCCGCCGCTGCTATTAAAAGACACTGTAGCGCTTAACTTGCTTGTCTGTGTGT
ATATGTATGTCCGCCGACCAGAAGGAGGAGTGTGAAGAGGCGCGTCGCCGAGTTGCAAGATGGCCACCCCATCGATGCTGCC
CCAGTGGGCGTACATGCACATCGCCGGACAGGACGCTTCGGAGTACCTGAGTCCGGGTCTGGTGCAGTTCGCCCGCGCCACA
GACACCTACTTCAGTCTGGGGAACAAGTTTAGGAACCCACGGTGGCGCCCACGCACGATGTGACCACCGACCGCAGCCAGC
GGCTGACGCTGCGCTTCGTGCCCGTGGACCGCGAGGACAACACCTACTCGTACAAAGTGCGCTACACGCTGGCCGTGGGCGA
CAACCGCGTGCTGGACATGGCCAGCACCTACTTTGACATCCGCGGCGTGCTGGACCGGGGCCCTAGCTTCAAACCCTACTCTG
GCACCGCCTACAACAGCCTAGCTCCCAAGGGAGCTCCCAATTCCAGCCAGTGGGAGCAAGCAAAAACAGGCAATGGGGGAAC
TATGGAAACACACACATATGGTGTGGCCCCAATGGGCGGAGAGAATATTACAAAAGATGGTCTTCAAATTGGAACTGACGTTA
CAGCGAATCAGAATAAACCAATTTATGCCGACAAAACATTTCAACCAGAACCGCAAGTAGGAGAAGAAAATTGGCAAGAAAC
TGAAAACTTTTATGGCGGTAGAGCTCTTAAAAAAGACACAAACATGAAACCTTGCTATGGCTCCTATGCTAGACCCACCAATGA
AAAAGGAGGTCAAGCTAAACTTAAAGTTGGAGATGATGGAGTTCCAACCAAAGAATTCGACATAGACCTGGCTTTCTTTGATA
CTCCCGGTGGCACCGTGAACGGTCAAGACGAGTATAAAGCAGACATTGTCATGTATACCGAAAACACGTATTTGGAAACTCCA
GACACGCATGTGGTATACAAACCAGGCAAGGATGATGCAAGTTCTGAAATTAACCTGGTTCAGCAGTCTATGCCCAACAGACC
CAACTACATTGGGTTCAGGGACAACTTTATCGGTCTTATGTACTACAACAGCACTGGCAATATGGGTGTGCTTGCTGGTCAGGC
CTCCCAGCTGAATGCTGTGGTTGATTTGCAAGACAGAAACACCGAGCTGTCCTACCAGCTCTTGCTTGACTCTTTGGGTGACAG
AACCCGGTATTTCAGTATGTGGAACCAGGCGGTGGACAGTTATGACCCGATGTGCGCATCATCGAAAACCATGGTGTGGAG
GATGAATTGCCAAACTATTGCTTCCCCTTGGACGGCTCTGGCACTAACGCCGCATACCAAGGTGTGAAAGTAAAGATGGTCA
AGATGGTGATGTTGAGAGTGAATGGGAAAATGACGATACTGTTGCAGCTCGAAATCAATTATGTAAAGGTAACATTTTCGCCA
TGGAGATTAATCTCCAGGCTAACCTGTGGAGAAGTTTCCTCTACTCGAACGTGGCCCTGTACCTGCCCGACTCCTACAAGTACA
CGCCGACCAACGTCACGCTGCCGACCAACACCAACACCTACGATTACATGAATGGCAGAGTGACACCTCCCTCGCTGGTAGAC

Fig. 21F

```
GCCTACCTCAACATCGGGGCGCGCTGGTCGCTGGACCCCATGGACAACGTCAACCCCTTCAACCACCACCGCAACGCGGGCCT
GCGCTACCGCTCCATGCTCCTGGGCAACGGGCGCTACGTGCCCTTCCACATCCAGGTGCCCCAAAAGTTTTTCGCCATCAAGAG
CCTCCTGCTCCTGCCCGGGTCCTACACCTACGAGTGGAACTTCCGCAAGGACGTCAACATGATCCTGCAGAGCTCCCTAGGCAA
CGACCTGCGCACGGACGGGGCCTCCATCGCCTTCACCAGCATCAACCTCTACGCCACCTTCTTCCCCATGGCGCACAACACCGC
CTCCACGCTCGAGGCCATGCTGCGCAACGACACCAACGACCAGTCCTTCAACGACTACCTCTCGGCGGCCAACATGCTCTACCC
CATCCCGGCCAACGCCACCAACGTGCCCATCTCCATCCCCTCGCGCAACTGGGCCGCCTTCCGCGGATGGTCCTTCACGCGCCT
GAAGACCCGCGAGACGCCCTCGCTCGGCTCCGGGTTCGACCCCTACTTCGTCTACTCGGGCTCCATCCCCTACCTAGACGGCAC
CTTCTACCTCAACCACACCTTCAAGAAGGTCTCCATCACCTTCGACTCCTCCGTCAGCTGGCCCGGCAACGACCGCCTCCTGACG
CCCAACGAGTTCGAAATCAAGCGCACCGTCGACGGAGAGGGATACAACGTGGCCCAGTGCAACATGACCAAGGACTGGTTCC
TGGTCCAGATGCTGGCCCACTACAACATCGGCTACCAGGGCTTCTACGTGCCCGAGGGCTACAAGGACCGCATGTACTCCTTCT
TCCGCAACTTCCAGCCCATGAGCCGCCAGGTCGTGGACGAGGTCAACTACAAGGACTACCAGGCCGTCACCCTGGCCTACCAG
CACAACAACTCGGGCTTCGTCGGCTACCTCGCGCCCACCATGCGCCAGGGCCAGCCCTACCCCGCCAACTACCCCTACCCGCTC
ATCGGCAAGAGCGCCGTCGCCAGCGTCACCCAGAAAAAGTTCCTCTGCGACCGGGTCATGTGGCGCATCCCCTTCTCCAGCAA
CTTCATGTCCATGGGCGCGCTCACCGACCTCGGCCAGAACATGCTCTACGCCAACTCCGCCCACGCGCTAGACATGAATTTCGA
AGTCGACCCCATGGATGAGTCCACCCTTCTCTATGTTGTCTTCGAAGTCTTCGACGTCGTCCGAGTGCACCAGCCCCACCGCGG
CGTCATCGAAGCCGTCTACCTGCGCACGCCCTTCTCGGCCGGCAACGCCACCACCTAAGCCGCTCTTGCTTCTTGCAAGATGAC
GGCGGGCTCCGGCGAGCAGGAGCTCAGGGCCATCCTCCGCGACCTGGGCTGCGGGCCCTGCTTCCTGGGCACCTTCGACAAG
CGCTTCCCTGGATTCATGGCCCCGCACAAGCTGGCCTGCGCCATCGTGAACACGGCCGGCCGCGAGACCGGGGGCGAGCACT
GGCTGGCCTTCGCCTGGAACCCGCGCTCCCACACATGCTACCTCTTCGACCCCTTCGGGTTCTCGGACGAGCGCCTCAAGCAGA
TCTACCAGTTCGAGTACGAGGGCCTGCTGCGTCGCAGCGCCCTGGCCACCGAGGACCGCTGCGTCACCCTGGAAAAGTCCACC
CAGACCGTGCAGGGTCCGCGCTCGGCCGCCTGCGGGCTCTTCTGCTGCATGTTCCTGCACGCCTTCGTGCACTGGCCCGACCG
CCCCATGGACAAGAACCCCACCATGAACTTACTGACGGGGGTGCCCAACGGCATGCTCCAGTCGCCCCAGGTGGAACCCACCC
TGCGCCGCAACCAGGAAGCGCTCTACCGCTTCCTCAATGCCCACTCCGCCTACTTTCGCTCCCACCGCGCGCGCATCGAGAAGG
CCACCGCCTTCGACCGCATGAATCAAGACATGTAAAAAACCGGTGTGTGTATGTGAATGCTTTATTCATAATAAACAGCACATG
TTTATGCCACCTTCTCTGAGGCTCTGACTTTATTTAGAAATCGAAGGGGTTCTGCCGGCTCTCGGCATGGCCCGCGGGCAGGG
ATACGTTGCGGAACTGGTACTTGGGCAGCCACTTGAACTCGGGGATCAGCAGCTTGGGCACGGGGAGGTCGGGGAACGAGT
CGCTCCACAGCTTGCGCGTGAGTTGCAGGGCGCCCAGCAGGTCGGGCGCGGAGATCTTGAAATCGCAGTTGGGACCCGCGTT
CTGCGCGCGAGAGTTGCGGTACACGGGGTTGCAGCACTGGAACACCATCAGGGCCGGGTGCTTCACGCTTGCCAGCACCGTC
GCGTCGGTGATGCCCTCCACGTCCAGATCCTCGGCGTTGGCCATCCCGAAGGGGGTCATCTTGCAGGTCTGCCGCCCCATGCT
GGGCACGCAGCCGGGCTTGTGGTTGCAATCGCAGTGCAGGGGGATCAGCATCATCTGGGCCTGCTCGGAGCTCATGCCCGGG
TACATGGCCTTCATGAAAGCCTCCAGCTGGCGGAAGGCCTGCTGCGCCTTGCCGCCCTCGGTGAAGAAGACCCCGCAGGACTT
GCTAGAGAACTGGTTGGTGGCGCAGCCGGCGTCGTGCACGCAGCAGCGCGCGTCGTTGTTGGCCAGCTGCACCACGCTGCGC
CCCCAGCGGTTCTGGGTGATCTTGGCCCGGTTGGGGTTCTCCTTCAGCGCGCGCTGCCCGTTCTCGCTCGCCACATCCATCTCG
ATAGTGTGCTCCTTCTGGATCATCACGGTCCCGTGCAGGCACCGCAGCTTGCCCTCGGCTTCGGTGCAGCCGTGCAGCCACAG
CGCGCAGCCGGTGCACTCCCAGTTCTTGTGGGCGATCTGGGAGTGCGAGTGCACGAAGCCCTGCAGGAAGCGGCCCATCATC
GCGGTCAGGGTCTTGTTGCTGGTGAAGGTCAGCGGGATGCCGCGGTGCTCCTCGTTCACATACAGGTGGCAGATGCGGCGGT
ACACCTCGCCCTGCTCGGGCATCAGCTGGAAGGCGGACTTCAGGTCGCTCTCCACGCGGTACCGGTCCATCAGCAGCGTCATC
ACTTCCATGCCCTTCTCCCAGGCCGAAACGATCGGCAGGCTCAGGGGGTTCTTCACCGCCATTGTCATCTTAGTCGCCGCCGCC
GAGGTCAGGGGGTCGTTCTCGTCCAGGGTCTCAAACACTCGCTTGCCGTCCTTCTCGATGATGCGCACGGGGGGAAAGCTGA
AGCCCACGGCCGCCAGCTCCTCCTCGGCCTGCCTTTCGTCCTCGCTGTCCTGGCTGATGTCTTGCAAAGGCACATGCTTGGTCTT
GCGGGGTTTCTTTTTGGGCGGCAGAGGCGGCGGCGATGTGCTGGGAGAGCGCGAGTTCTCGTTCACCACGACTATTTCTTCTT
CTTGGCCGTCGTCCGAGACCACGCGGCGGTAGGCATGCCTCTTCTGGGGCAGAGGCGGAGGCGACGGGCTCTCGCGGTTCG
GCGGGCGGCTGGCAGAGCCCCTTCCGCGTTCGGGGGTGCGCTCCTGGCGGCGCTGCTCTGACTGACTTCCTCCGCGGCCGGC
CATTGTGTTCTCCTAGGGAGCAACAACAAGCATGGAGACTCAGCCATCGTCGCCAACATCGCCATCTGCCCCCGCCGCCACCGC
CGACGAGAACCAGCAGCAGAATGAAAGCTTAACCGCCCCGCCGCCCAGCCCCACCTCCGACGCCGCGGCCCCAGACATGCAA
GAGATGGAGGAATCCATCGAGATTGACCTGGGCTACGTGACGCCCGCGGAGCACGAGGAGGAGCTGGCAGCGCGCTTTTCA
GCCCCGGAAGAGAACCACCAAGAGCAGCCAGAGCAGGAAGCAGAGAACGAGCAGAACCAGGCTGGGCACGAGCATGGCGA
CTACCTGAGCGGGGCAGAGGACGTGCTCATCAAGCATCTGGCCCGCCAATGCATCATCGTCAAGGACGCGCTGCTCGACCGC
GCCGAGGTGCCCCTCAGCGTGGCGGAGCTCAGCCGCGCCTACGAGCGCAACCTCTTCTCGCCGCGCGTGCCCCCAAGCGCCA
GCCCAACGGCACCTGTGAGCCCAACCCGCGCCTCAACTTCTACCCGGTCTTCGCGGTGCCCGAGGCCCTGGCCACCTACCACCT
```

Fig. 21G

CTTTTTCAAGAACCAAAGGATCCCCGTCTCCTGCCGCGCCAACCGCACCCGCGCCGACGCCCTGCTCAACCTGGGCCCCGGCGC
CCGCCTACCTGATATCACCTCCTTGGAAGAGGTTCCCAAGATCTTCGAGGGTCTGGGCAGCGACGAGACTCGGGCCGCGAACG
CTCTGCAAGGAAGCGGAGAGGAGCATGAGCACCACAGCGCCCTGGTGGAGTTGGAAGGCGACAACGCGCGCCTGGCGGTCC
TCAAGCGCACGGTCGAGCTGACCCACTTCGCCTACCCGGCGCTCAACCTGCCCCCCAAGGTCATGAGCGCCGTCATGGACCAG
GTGCTCATCAAGCGCGCCTCGCCCCTCTCGGAGGAGGAGATGCAGGACCCCGAGAGTTCGGACGAGGGCAAGCCCGTGGTCA
GCGACGAGCAGCTGGCGCGCTGGCTGGGAGCGAGTAGCACCCCCAGAGCCTGGAAGAGCGGCGCAAGCTCATGATGGCCG
TGGTCCTGGTGACCGTGGAGCTGGAGTGTCTGCGCCGCTTCTTTGCCGACGCGGAGACCCTGCGCAAGGTCGAGGAGAACCT
GCACTACCTCTTCAGGCACGGGTTCGTGCGCCAGGCCTGCAAGATCTCCAACGTGGAGCTGACCAACCTGGTCTCCTACATGG
GCATCCTGCACGAGAACCGCCTGGGGCAAAACGTGCTGCACACCACCCTGCGCGGGGAGGCCCGCCGCGACTACATCCGCGA
CTGCGTCTACCTGTACCTCTGCCACACCTGGCAGACGGGCATGGGCGTGTGGCAGCAGTGCCTGGAGGAGCAGAACCTGAAA
GAGCTCTGCAAGCTCCTGCAGAAGAACCTCAAGGCCCTGTGGACCGGGTTCGACGAGCGTACCACCGCCTCGGACCTGGCCG
ACCTCATCTTCCCCGAGCGCCTGCGGCTGACGCTGCGCAACGGGCTGCCCGACTTTATGAGCCAAAGCATGTTGCAAAACTTTC
GCTCTTTCATCCTCGAACGCTCCGGGATCCTGCCCGCCACCTGCTCCGCGCTGCCCTCGGACTTCGTGCCGCTGACCTTCCGCGA
GTGCCCCCCGCCGCTCTGGAGCCACTGCTACTTGCTGCGCCTGGCCAACTACCTGGCCTACCACTCGGACGTGATCGAGGACG
TCAGCGGCGAGGGTCTGCTGGAGTGCCACTGCCGCTGCAACCTCTGCACGCCGCACCGCTCCCTGGCCTGCAACCCCCAGCTG
CTGAGCGAGACCCAGATCATCGGCACCTTCGAGTTGCAAGGCCCCGGCGACGGCGAGGGCAAGGGGGGTCTGAAACTCACC
CCGGGGCTGTGGACCTCGGCCTACTTGCGCAAGTTCGTGCCCGAGGACTACCATCCCTTCGAGATCAGGTTCTACGAGGACCA
ATCCCAGCCGCCCAAGGCCGAGCTGTCGGCCTGCGTCATCACCCAGGGGGCCATCCTGGCCCAATTGCAAGCCATCCAGAAAT
CCCGCCAAGAATTTCTGCTGAAAAAGGGCCACGGGGTCTACTTGGACCCCCAGACCGGAGAGGAGCTCAACCCCAGCTTCCCC
CAGGATGCCCCGAGGAAGCAGCAAGAAGCTGAAAGTGGAGCTGCCGCCGCCGGAGGATTTGGAGGAAGACTGGGAGAGCA
GTCAGGCAGAGGAGGAGGAGATGGAAGACTGGGACAGCACTCAGGCAGAGGAGGACAGCCTGCAAGACAGTCTGGAGGAG
GAAGACGAGGTGGAGGAGGCAGAGGAAGAAGCAGCCGCCGCCAGACCGTCGTCCTCGGCGGAGAAAGCAAGCAGCACGGA
TACCATCTCCGCTCCGGGTCGGGTCGCGGCGGCCGGGCCCACAGTAGGTGGGACGAGACCGGGCGCTTCCCGAACCCCACC
ACCCAGACCGGTAAGAAGGAGCGGCAGGGATACAAGTCCTGGCGGGGGCACAAAAACGCCATCGTCTCCTGCTTGCAAGCCT
GCGGGGGCAACATCTCCTTCACCCGGCGCTACCTGCTCTTCCACCGCGGGGTGAACTTCCCCCGCAACATCTTGCATTACTACC
GTCACCTCCACAGCCCCTACTACTGTTTCCAAGAAGAGGCAGAAACCCAGCAGCAGCAGAAAACCAGCGGCAGCAGCAGCTA
GAAAATCCACAGCGGCGGCAGGTGGACTGAGGATCGCGGCGAACGAGCCGGCGCAGACCCGGGAGCTGAGGAACCGGATC
TTTCCCACCCTCTATGCCATCTTCCAGCAGAGTCGGGGGCAGGAGCAGGAACTGAAAGTCAAGAACCGTTCTCTGCGCTCGCT
CACCCGCAGTTGTCTGTATCACAAGAGCGAAGACCAACTTCAGCGCACTCTCGAGGACGCCGAGGCTCTCTTCAACAAGTACT
GCGCGCTCACTCTTAAAGAGTAGCCCGCGCCCGCCCACACACGGAAAAAGGCGGGAATTACGTCACCACCTGCGCCCTTCGCC
CGACCATCATGAGCAAAGAGATTCCCACGCCTTACATGTGGAGCTACCAGCCCCAGATGGGCCTGGCCGCCGGCGCCGCCCA
GGACTACTCCACCCGCATGAACTGGCTCAGTGCCGGGCCCGCGATGATCTCACGGGTGAATGACATCCGCGCCCACCGAAACC
AGATACTCCTAGAACAGTCAGCGATCACCGCCACGCCCCGCCATCACCTTAATCCGCGTAATTGGCCCGCCGCCCTGGTGTACC
AGGAAATTCCCCAGCCCACGACCGTACTACTTCCGCGAGACGCCCAGGCCGAAGTCCAGCTGACTAACTCAGGTGTCCAGCTG
GCCGGCGGCGCCGCCCTGTGTCGTCACCGCCCGCTCAGGGTATAAAGCGGCTGGTGATCCGAGGCAGAGGCACACAGCTCA
ACGACGAGGTGGTGAGCTCTTCGCTGGGTCTGCGACCTGACGGAGTCTTCCAACTCGCCGGATCGGGGAGATCTTCCTTCACG
CCTCGTCAGGCCGTCCTGACTTTGGAGAGTTCGTCCTCGCAGCCCCGCTCGGGCGGCATCGGCACTCTCCAGTTCGTGGAGGA
GTTCACTCCCTCGGTCTACTTCAACCCCTTCTCCGGCTCCCCGGCCACTACCCGGACGAGTTCATCCCGAACTTCGACGCCATC
AGCGAGTCGGTGGACGGCTACGATTGAATGTCCCATGGTGGCGCAGCTGACCTAGCTCGGCTTCGACACCTGGACCACTGCC
GCCGCTTCCGCTGCTTCGCTCGGGATCTCGCCGAGTTTGCCTACTTTGAGCTGCCCGAGGAGCACCCTCAGGGCCCAGCCCAC
GGAGTGCGGATCATCGTCGAAGGGGCCTCGACTCCCACCTGCTTCGGATCTTCAGCCAGCGACCGATCCTGGTCGAGCGCG
AACAAGGACAGACCCTTCTTACTTTGTACTGCATCTGCAACCACCCCGGCCTGCATGAAAGTCTTTGTTGTCTGCTGTGTACTGA
GTATAATAAAAGCTGAGATCAGCGACTACTCCGGACTCGATTGTGGTGTTCCTGCTATCAACCGGTCCCTGTTCTTCACCGGGA
ACGAGACCGAGCTCCAGCTCCAGTGTAAGCCCCACAAGAAGTACCTCACCTGGCTGTTCCAGGGCTCCCCGATCGCCGTTGTC
AACCACTGCGACAACGACGGAGTCCTGCTGAGCGGCCCTGCCAACCTTACTTTTCCACCCGCAGAAGCAAGCTCCAGCTCTTC
CAACCCCTTCCTCCCCGGGACCTATCAGTGCGTCTCAGGACCCTGCCATCACACCTTCCACCTGATCCCGAATACCACAGCGCCGC
TCCCCGCTACTAACAACCAAACTACCCACCAACGCCACCGTCGCGACCTTTCCTCTGAATCTAATACCACTACCGGAGGTGAGC
TCCGAGGTCGACCAACCTCTGGGATTTACTACGGCCCCTGGGAGGTGGTGGGGTTAATAGCAAATAAAAAAAATAATCATTTG
ATTTGAAATAAAGATACAATCATATTGATGATTTGAGTTTAACAAAAATAAAGAATCACTTACTTGAAATCTGATACCAGGTCTC
TGTCCATGTTTTCTGCCAACACCACCTCACTCCCCTCTTCCCAGCTCTGGTACTGCAGGCCCGGCGGGCTGCAAACTTCCTCCA

Fig. 21H

```
CACGCTGAAGGGGATGTCAAATTCCTCCTGTCCCTCAATCTTCATTTTATCTTCTATCAGATGTCCAAAAAGCGCGTCCGGGTGG
ATGATGACTTCGACCCCGTCTACCCCTACGATGCAGACAACGCACCGACCGTGCCCTTCATCAACCCCCCCTTCGTCTCTTCAGA
TGGATTCCAAGAGAAGCCCCTGGGGGTGTTGTCCCTGCGACTGGCTGACCCCGTCACCACCAAGAACGGGGAAATCACCCTCA
AGCTGGGAGAGGGGTGGACCTCGACTCGTCGGGAAAACTCATCTCCAACACGGCCACCAAGGCCGCCGCCCCTCTCAGTAT
TTCAAACAACACCATTTCCCTTAAAACTGCTGCCCCTTCTACAACAACAATGGAACTTTAAGCCTCAATGTCTCCACACCATTAG
CAGTATTTCCCACATTTAACACTTTAGGCATAAGTCTTGGAAACGGTCTTCAGACTTCAAATAAGTTGTTGACTGTACAACTAAC
TCATCCTCTTACATTCAGCTCAAATAGCATCACAGTAAAAACAGACAAAGGGCTATATATTAACTCCAGTGGAAACAGAGGACT
TGAGGCTAATATAAGCCTAAAAAGAGGACTAGTTTTTGACGGTAATGCTATTGCAACATATATTGGAAATGGCTTAGACTATG
GATCTTATGATAGTGATGGAAAAACAAGACCCGTAATTACCAAAATTGGAGCAGGATTAAATTTTGATGCTAACAAAGCAATA
GCTGTCAAACTAGGCACAGGTTTAAGTTTTGACTCCGCTGGTGCCTTGACAGCTGGAAACAAACAGGATGACAAGCTAACACT
TTGGACTACCCCTGACCCAAGCCCTAATTGTCAATTACTTTCAGACAGAGATGCCAAATTTACTCTCTGTCTTACAAAATGCGGT
AGTCAAATACTAGGCACTGTGGCAGTGGCGGCTGTTACTGTAGGATCAGCACTAAATCCAATTAATGACACAGTCAAAAGCGC
CATAGTTTTCCTTAGATTTGATTCCGATGGTGTACTCATGTCAAACTCATCAATGGTAGGTGATTACTGGAACTTTAGGGAGGG
ACAGACCACTCAAAGTGTAGCCTATACAAATGCTGTGGGATTCATGCCAAATATAGGTGCATATCCAAAAACCCAAAGTAAAA
CACCTAAAAATAGCATAGTCAGTCAGGTATATTTAACTGGAGAAACTACTATGCCAATGACACTAACCATAACTTTCAATGGCA
CTGATGAAAAGACACAACCCCAGTTAGCACCTACTCTATGACTTTTACATGGCAGTGGACTGGAGACTATAAGGACAAAAAT
ATTACCTTTGCTACCAACTCATTCTCTTTTTCCTACATCGCCCAGGAATAATCCCACCCAGCAAGCCAACCCCTTTTCCCACCACC
TTTGTCTATATGGAAACTCTGAAACAGAAAAATAAAGTTCAAGTGTTTTATTGAATCAACAGTTTTACAGGACTCGAGCAGTTA
TTTTTCCTCCACCCTCCCAGGACATGGAATACACCACCCTCTCCCCCCGCACAGCCTTGAACATCTGAATGCCATTGGTGATGGA
CATGCTTTTGGTCTCCACGTTCCACACAGTTTCAGAGCGAGCCAGTCTCGGATCGGTCAGGGAGATGAAACCCTCCGGGCACT
CCCGCATCTGCACCTCACAGCTCAACAGCTGAGGATTGTCCTCGGTGGTCGGGATCACGGTTATCTGGAAGAAGCAGAAGAGC
GGCGGTGGGAATCATAGTCCGCGAACGGGATCGGCCGGTGGTGTCGCATCAGGCCCCGCAGCAGTCGCTGCCGCCGCCGCTC
CGTCAAGCTGCTGCTCAGGGGGTTCGGGTCCAGGGACTCCCTCAGCATGATGCCCACGGCCCTCAGCATCAGTCGTCTGGTGC
GGCGGGCGCAGCAGCGCATGCGAATCTCGCTCAGGTCACTGCAGTACGTGCAACACAGGACCACCAGGTTGTTCAACAGTCC
ATAGTTCAACACGCTCCAGCCGAAACTCATCGCGGGAAGGATGCTACCCACGTGGCCGTCGTACCAGATCCTCAGGTAAATCA
AGTGGCGCTCCCTCCAGAAGACGCTGCCCATGTACATGATCTCCTTGGGCATGTGGCGGTTCACCACCTCCCGGTACCACATCA
CCCTCTGGTTGAACATGCAGCCCCGGATGATCCTGCGGAACCACAGGGCCAGCACCGCCCCGCCCGCCATGCAGCGAAGAGA
CCCCGGATCCCGGCAATGACAATGGAGGACCCACCGCTCGTACCCGTGGATCATCTGGGAGCTGAACAAGTCTATGTTGGCAC
AGCACAGGCATATGCTCATGCATCTCTTCAGCACTCTCAGCTCCTCGGGGGTCAAAACCATATCCCAGGGCACGGGGAACTCTT
GCAGGACAGCGAACCCCGCAGAACAGGGCAATCCTCGCACATAACTTACATTGTGCATGGACAGGGTATCGCAATCAGGCAG
CACCGGGTGATCCTCCACCAGAGAAGCGCGGGTCTCGGTCTCCTCACAGCGTGGTAAGGGGCCGGCCGATACGGGTGATGG
CGGGACGCGGCTGATCGTGTTCTCGACCGTGTCATGATGCAGTTGCTTTCGGACATTTTCGTACTTGCTGTAGCAGAACCTGGT
CCGGGCGCTGCACACCGATCGCCGGCGGCGGTCTCGGCGCTTGGAACGCTCGGTGTTAAAGTTGTAAAACAGCCACTCTCTCA
GACCGTGCAGCAGATCTAGGGCCTCAGGAGTGATGAAGATCCCATCATGCCTGATAGCTCTGATCACATCGACCACCGTGGAA
TGGGCCAGGCCCAGCCAGATGATGCAATTTTGTTGGGTTTCGGTGACGGCGGGGAGGGAAGAACAGGAAGAACCATGATT
AACTTTTAATCCAAACGGTCTCGGAGCACTTCAAAATGAAGGTCACGGAGATGGCACCTCTCGCCCCGCTGTGTTGGTGGAA
AATAACAGCCAGGTCAAAGGTGATACGGTTCTCGAGATGTTCCACGGTGGCTTCCAGCAAAGCCTCCACGCGCACATCCAGAA
ACAAGACAATAGCGAAAGCGGGAGGGTTCTCTAATTCCTCAACCATCATGTTACACTCCTGCACCATCCCCAGATAATTTTCATT
TTTCCAGCCTTGAATGATTCGAACTAGTTCCTGAGGTAAATCCAAGCCAGCCATGATAAAAAGCTCGCGCAGAGCACCCTCCAC
CGGCATTCTTAAGCACACCCTCATAATTCCAAGATATTCTGCTCCTGGTTCACCTGCAGCAGATTGACAAGCGGAATATCAAAA
TCTCTGCCGCGATCCCTGAGCTCCTCCCTCAGCAATAACTGTAAGTACTCTTTCATATCGTCTCCGAAATTTTTAGCCATAGGACC
CCCAGGAATAAGAGAAGGGCAAGCCACATTACAGATAAACCGAAGTCCCCCCAGTGAGCATTGCCAAATGTAAGATTGAAA
TAAGCATGCTGGCTAGACCCGGTGATATCTTCCAGATAACTGGACAGAAAATCGGGTAAGCAATTTTTAAGAAAATCAACAAA
AGAAAAATCTTCCAGGTGCACGTTTAGGGCCTCGGGAACAACGATGGAGTAAGTGCAAGGGGTGCGTTCCAGCATGGTTAGT
TAGCTGATCTGTAAAAAAACAAAAAATAAAACATTAAACCATGCTAGCCTGGCGAACAGGTGGGTAAATCGTTCTCTCCAGCA
CCAGGCAGGCCACGGGGTCTCCGGCGCGACCCTCGTAAAAATTGTCGCTATGATTGAAAACCATCACAGAGAGACGTTCCCG
GTGGCCGGCGTGAATGATTCGAGAAGAAGCATACACCCCCGGAACATTGGAGTCCGTGAGTGAAAAAAAGCGGCCGAGGAA
GCAATGAGGCACTACAACGCTCACTCTCAAGTCCAGCAAAGCGATGCCATGCGGATGAAGCACAAAATTTTCAGGTGCGTAAA
AAATGTAATTACTCCCCTCCTGCACAGGCAGCGAAGCTCCCGATCCCTCCAGATACACATACAAAGCCTCAGCGTCCATAGCTT
ACCGAGCGGCAGCAGCAGCGGCACACAACAGGCGCAAGAGTCAGAGAAAAGACTGAGCTCTAACCTGTCCGCCCGCTCTCTG
CTCAATATATAGCCCCAGATCTACACTGACGTAAAGGCCAAAGTCTAAAAATACCCGCCAAATAATCACACACGCCCAGCACAC
GCCCAGAAACCGGTGACACACTCAGAAAAATACGCGCACTTCCTCAAACGGCCAAACTGCCGTCATTTCCGGGTTCCCACGCTA
CGTCATCAAAACACGACTTTCAAATTCCGTCGACCGTTAAAAACATCACCCGCCCCGCCCCTAACGGTCGCCGCTCCCGCAGCC
AATCACCTTCCTCCCTCCCCAAATTCAAACAGCTCATTTGCATATTAACGCGCACCAAAAGTTTGAGGTATATTATTGATGATG
```

Fig. 21I

AdC6 010-HIVgag (E1026)  Amino acids – SEQ ID NO: 10
The symbol " * " refers herein to stop codons in the non coding regions HHQ*YTSNFWCALICK*AV*IWGGRKVIGCGSGDR*GRGG*RFDDVAMRRSRFASSRGKSDVKRGVV*TRKYSIFPRSLTGNEVFL
GGCK*KRAIFARKLNEEVKI*VISRLWQGGVFAEGRVDFDRLRGGFDYRIFHLNFRVRCQSPVFLRTISFPRKCHLTVTITVLR*RKLRS
PDPLWCTLSTICSDAA*LSQYLLPACVLEVAE*CASKI*ATTRQGLTDNCMKNLLRVRRFALLRDVRARYTR*H*LLTSY***SITGSLV
HSPYMEFRVT*LTVNGPPG*PPNDPRPLTSIMTYVPIVTPIGTFH*RQWVEYLR*TAHLAVHQVYHMPSTPPIDVNDGKWPAWHY
AQYMTLWDFPTWQYIYVLVIAITMVMRFWQYINGRG*RFDSRGFPSLHPIDVNGSLFWHQNQRDFPKCRNNSAPLTQMGGRRV
RWEVYISRARLVNRQITRSFIAVVYHS*IANAVSASDTTVSNLSCRSWS*GTGQVSIKVTRQV*GDQ*KLGLSRQRRLLRF**APIGLT
DIHFAFLSTGVHSQFNYSS*G*ST*YDSL*ASATMGARASVLSGGELDRWEKIRLRPGGKKKYKLKHIVWASRELERFAVNPGLLETS
EGCRQILGQLQPSLQTGSEELRSLYNTVATLYCVHQRIEVKDTKEALEKIEEEQNKSKKKAQQAAADTGNSSQVSQNYPIVQNLQGQ
MVHQAISPRTLNAWVKVVEEKAFSPEVIPMFSALSEGATPQDLNTMLNTVGGHQAAMQMLKETINEEAAEWDRLHPVHAGPIA
PGQMREPRGSDIAGTTSTLQEQIGWMTNNPPIPVGEIYKRWIILGLNKIVRMYSPTSILDIRQGPKEPFRDYVDRFYKTLRAEQASQE
VKNWMTETLLVQNANPDCKTILKALGPAATLEEMMTACQGVGGPGHKARVLAEAMSQVTNSATIMMQRGNFRNQRKTVKCFN
CGKEGHIAKNCRAPRKKGCWKCGKEGHQMKDCTERQANFLGKIWPSHKGRPGNFLQSRPEPTAPPEESFRFGEETTTPSQKQEPI
DKELYPLASLRSLFGNDPSSQ**SSV*TGPLESTRAAKPLISLDCAF*LPAICCLPLPRAFLDPGRCHSHCPFLIK*GNCIALSE*VSFYSG
GWGGAGQQGGGLGRQ*QACWGCGGLYGF*GGKNQQICRSEFIYVGCGERGNEMVLWVLWVCINESVRYRHMLATVHVASHP
RKTWPEFEHNVMTRCNVHLGSRRGMFMPYQCNMQFVKVLLEPDAMSRVSLTGVFDMNVELWKILRYDESKTRCRACECGGKH
ARLQPVCVEVTEDLRPDHLVLSCNGTEFGSSGEESD*SE*CLGLGVSLHEGQND*NLWFSVCCSSMSGSASFEGGVFSPYLTGRLPS
WAGVRQNVMGSTVDGRPVQPANSSTLTYATLSSSSVDAAAAAAAASAASAVRGMALGAGYYSSLVANSSSTNNPASLNEEKLLLL
MAQLEALTQRLGELTQQVAQLQAETRAAVATVKTK*KMNQ*INGDGC*F*HRVLNLYLIFRAR*ALDHRSRSLSTRWIFSRTR*RW
AWMLRYMGMSPSRGWR*LHCRASCSGMVL*ITQS*QGRRAWCCTMSLRRRLMATGSPLV*VLTNLLSWEGCMRGEMRCILA
WILRLAMFPPRSRRGFMLCRTTSTVYPVHLGNLSCNLEGKA*KNLETPL*PPRFSMHSSMMMAMGPWAAAWAKTFRGSDTS*L
WSWVSSS*AILMNLGRRVPDWGTKVPSIPGA*LPSQICISQALSSEGGIMSTCGAMKKTVSGAGEMSWAESRFSSWDLPQPVGP
*MTPMTGCRW*LRERQLPSSRRRGATSFIISRTCMFSRTSSARRRSPPSERSSCSEAKFFSGLSPSAMGILERVCCKSSRRSQSSVMCS
RASRSSRPPRFAGWGDCGSRAPGDGRPARPGSGPSRAAGSASAWSPSR*RGARRAGRLRGCASGSSGWSRTAPGRRPARRPGS
N*A*VRS*APRPRGPWRGAYLWKCVRRRDRGGT*GRRAWGRGRRTRGRRRPRRSWRRRSRTPRAR*GRGGWGQKRGFLRAF*
CVSYLWSP*ARVPAG*QRGCPCPRRPTLWAGPRAGCRGPRRRGTPPTPRRRPGSRPARRRPRGRGSGRCPPAGPPSPGYASTCPP
RPHPGR*LACKCRPRDRGSRPGGYKRGRAPARPHCLPDRCPGAPAVGVGIPSRRRA*PRHSGCQFLETRRI*Y*RCRWRRLS*APR
PFGQKRRSFCCRAWWRRSRRGRWRAAWRWSAWSGSFPCRRAPWRRC*AARTRAPRTSIRGRRW*ARRARF*PASRGCAG**G
PRWWPPRRAGARWSSRGARPCASRRGAAGPA*ARRGGRRPR*RCRAGARGRSS*CRCPDCPAPLASRARPARARRG*GACPRA
WGA*ARRRTCRRCRRRRGAPRGRRCRWGSSAPRGCWRARSRTARARARGAPCRGWSVAAFRRGRRSGGRWRGSWRRWWAF
GRC*SGRGAGRPSP**SGRRSPAAWRRARR*RGRPGRSSRGSLG*CHT*AGPSASTARG*EGTLRGPSSTLRGGTRPDRHGKSPPC
RTG*RPCRRSSPSPRGGRKLARPCAGRCG*GRRCRAP*P*GTGA*SRGRRSRPAPRVGSPCASCRRG*AKRK*HR*RGSCPRGA*S
CE*CGKAGAPRPGC**PGRRGRSRRSR*CCARRCRVPRIAGGP*RGAAS*ARRR*ARRGR*ARAARGPSRRRGGWR*GRKSRDPR
PGRSASGPGTDGTVGPRPFFRG*RSRRCGGRRASGPT*AGGRGRGRARRAAGPRRVS*PA*RGRAACRRTPSRCRFPHRR*GRAF
RCEDASRWGRTGSPATSWRNGC*CDGSRNADGAPSTRACVYTSVRSARNAARDARAARAVPGFLWRGISVGSGALAAASRAVLR
LGHRRGHRLPRWWSC*RARAGGRSRPRLGRVGERGRGRAGRSCPGS*DAAESGQWAAAARG*LAGAFPGRAGGPDGT*SPRR
RWWLRPRLAGCRAPGAPPPCPVSSWALLPCRSEAAARTRAGRQGRLGARRQGRQGHVGAARGQVLVLRPEKTGVSDDATVDVL
DLTPLGEGHGTREFEPEREFDRINLGIVDGGLPQDLLHVARVVLVGDLGHELLDLLLLKVSAAGALDGGREVVGDAAHELREGVHAG
LVPDAAVDHGSVGVARAHDHLGEVELDVAREDRVVAEALVEVVERGGDVLGDEEVHDPAAERHLADVAQGFQAFHGLVEVHGE
VEKLGVARRDGQLLLQKTDELGDGGAHLALEGPGGLLFHLLLFLLH*HLFYFLLRRRWRGRGPASPAAHGQTVDEALDGLPAPATH
GLGDGAPVLAGPQHEDAAAHLQVAAGGVSVGQGEGADDASYQLTRRDSAQGPERLEIHGIRKPLNEGFEPVAVAR*AEPGFLFFG
YLVGRRAGDAAGDEVEVGGPETADGGEEHQVLGPLLDAQTVGHAPGVVLTPGEVLVVVLHEPLHGHLLLARAAVHAREPEPALR
LDERQVGDDALGEDGLLDLGEGGLEVVEVDEAVVGSGVDGVGAVGHDGPVDGLVAGSHELVVLEARVGARVEDVVVAGAHEVL
VSDEEVRRRLAVERPSLGGGGAGREVLEHEAVVAVDVPGHPGDAGGGGGGARELADAVPDVAQRQEVVHGGRGLAREARAVVD
ALDIRAKTKAVSGSTPWPGG*ANGLGCACTPVRISNQAGAAANVVLALPSRPKPANETSRIRRRVVFWPWSLVMKN**ARKAAAR
DGSLP*SGERIARVALRCAPVRASALGAGRIPRLTWAWLPRRFQDPLASRLLQLRSEPLFFFLVFLPDASRTAADAPPPSTTTAPTAAA
ATAGASAPAPAAASHYRGGRRERSRRSV*PGLGRGRGAGAAGGVVAGAAPARADEKGRSRGLRAQAEPVQRQERRGARGDARL
PLPRGAGAAARPGPKAGAEGRGFRGGRADGDQPRARARGRGQPGHGVRADREGGEQLPKILQQPRAHLDRARGGDPGPDAPV
GPAGGHRAEPHEQAADGAAVSGGAAQSGQRDVQGGAAEYHRARGPLAPGPGEHFAEHRGAGARAAAVREAGGHQLLGAESG

Fig. 21J

QVLR*EDLQDPVRAHRQGGEDRRVLHAHDPESADPERRSGGVPQRQDAPRGERQPPARAERPGADAQPAAGPDRGRDRGGELL
*HGRGPALAAQPPGLGSCRRFPLRGGGGR*GGGGRVPGRLMARPYFC*MQQQPPPPPPDPAMRAALQSQPSGINSSDDWTQA
MQRIMALTTRNPEAFRQQPQANRLSAILEAVVPSRSNPTHEKVLAIVNALVENKAIRGDEAGLVYNALLERVARYNSTNVQTNLDR
MVTDVREAVSQRERFHRESNLGSMVALNAFLSTQPANVPRGQEDYTNFISALRLMVAEVPQSEVYQSGPDYFFQTSRQGLQTVNL
SQAFKNLQGLWGVQAPVGDRATVSSLLTPNSRLLLLLVAPFTDSGSVSRDSYLGYLLNLYREAIGQAHVDEQTYQEITHVSRALGQE
DPGNLEATLNFLLTNRSQKIPPQYALSTEEERILRYVQQSVGLFLMQEGATPSAALDMTARNMEPSMYARNRPFINKLMDYLHRAA
AMNSDYFTNAILNPHWLPPPGFYTGEYDMPDPNDGFLWDDVDSSVFSPRPGTNAVWKKEGGDRRPSSALSGRAGAAAAVPEAA
SPFPSLPFSLNSVRSSELGRLTRPRLLGEEEYLNDSLLRPEREKNFPNNGIESLVDKMSRWKTYAHEHRDEPRASSAGTRRRQRHDRQ
RGLVWDDEDSADDSSVLDLGGSGGNPFAHLRPRIGRLM*ESEKIKDGTHQGHGDQRAFFSVVCSSMMRRVYPEGPPPSYESVMQ
QAVAAAMQPPLEAPYVPPRYLAPTEGRNSIRYSELAPLYDTTRLYLVDNKSADIASLNYQNDHSNFLTTVVQNNDFTPTEASTQTINF
DERSRWGGQLKTIMHTNMPNVNEFMYSNKFKARVMVSRKTPNGVDDDYDGSQDELTYEWVEFELPEGNFSVTMTIDLMNNAII
DNYLAVGRQNGVLESDIGVKFDTRNFRLGWDPVTELVMPGVYTNEAFHPDIVLLPGCGVDFTESRLSNLLGIRKRQPFQEGFQILYE
DLEGGNIPALLDVEAYEKSKEDSTAAATAAVATASTEVRGDNFASAAAAAEAAETESKIVIQPVEKDSKDRSYNVLADKKNTAYRSW
YLAYNYGDPEKGVRSWTLLTTSDVTCGVEQVYWSLPDMMQDPVTFRSTRQVSNYPVVGAELLPVYSKSFFNEQAVYSQQLRAFTS
LTHVFNRFPENQILVRPPAPTITTVSENVPALTDHGTLPLRSSIRGVQRVTVTDARRRTCPYVYKALGVVAPRVLSSRTF*KMSILISPS
NNTGWGLRAPSKMYGGARQRSTQHPVRVRGHFRAPWGALKGRVRSRTTVDDVIDQVVADARNYTPAAAPVSTVDAVIDSVVAD
ARRYARTKSRRRRIARRHRSTPAMRAARALLRRARRTGRRAMLRAARRAASGSSSAGRTRRRAATAAAAAIASMSRPRRGNVYWV
RDAATGVRVPVRTRPPRT*RC*LRDVDVSQRRGGCPSANTRKRCSRSSRLRSTAPRRR*RRKESPAN*SGSKRTKRRRKMTDWWS
LCASSPPGGACSGAGGK*NRCCGPAPRWSSRPASVPAPPPSAPTTRCTGTRTSSSRRSSVWASLRTASAAAPRP*KRRRCPSRWTT
ATPRRA*SR*PCSRCYRARRRAGASSARAAARICTRPCS*WCPSARSWRTCWST*RWTPRCSPRSRCGPSSRWPRAWACRPWTSRS
PRSPWKRRPSP*SPAPAPWRCRRIPGCQHQLPPALAEDASTARPAC*CPTTRCILPSSPRRATAARASTAATPAAAAARPPPAAVVA
AAAAAPRLPPWCGECIAAGASL*PCRARATTRASPFNYRLLLADMALTCRLRVPITGYRGRKPRRRRLTGNGLRRHHHRRRRAISKR
LGGGFLPALIPIIAAAIGAIPGIASVAVQASQRH*DTKKHGFVIKKKMD*RSWSCDVCF*MEDINFSSLAPRHGTRPFMGTWSDIGN
SQLNGGAFNWSSLWSGLKNFGSTLKTYGNKAWNSSTGQALREKLKEQNFQQKVVDGLASGINGVVDLANQAVQKQINSRLDAV
PPAGSVEMPQVEEELPPLDKRGDKRPRPDAEETLLTHTDEPPPYEEAVKLGLPTTRPVAPLATGVLKPSSSQPATLDLPPPRPSTVAK
PLPPVAVASRAPRGRPQANWQSTLNSIVGLGVQSVKRRRCY*KTL*RLTCLSVCICMSADQKEECEEARRRVARWPPHRCCPSGRT
CTSPDRTLRST*VRVWCSSPAPQTPTSVWGTSLGTPRWRPRTM*PPTAASG*RCASCPWTARTTPTRTKCATRWPWATTACWT
WPAPTLTSAACWTGALASNPTLAPPTTA*LPRELPIPASGSKQKQAMGELWKHTHMVWPQWAERILQKMVFKLELTLQRIRINQF
MPTKHFNQNRK*EKKIGKKLKTFMAVELLKKTQT*NLAMAPMLDPPMKKEVKLNLKLEMMEFQPKNST*TWLSLILPVAP*TVKTS
IKQTLSCIPKTRIWKLQTRMWYTNQARMMQVLKLTWFSSLCPTDPTTLGSGTTLSVLCTTTALAIWVCLLVRPPS*MLWLICKTETP
SCPTSSCLTLWVTEPGISVCGTRRWTVMTPMCASSKTMVWRMNCQTIASPWTALALTPHTKV*K*KMVKMVMLRVNGKMTILL
QLEINYVKVTFSPWRLISRLTCGEVSSTRTWPCTCPTPTSTRRPTSRCRPTPTPTIT*MAE*HLPRW*TPTSTSGRAGRWTPWTTSTP
STTTATRACATAPCSWATGATCPSTSRCPKSFSPSRASCSCPGPTPTSGTSARTST*SCRAP*ATTCARTGPPSPSPASTSTPPSSPWR
TTPPPRSRPCCATTPTTSPSTTTSRRPTCSTPSRPTPPTCPSPSPRATGPPSADGPSRA*RPARRPRSAPGSTPTSSTRAPSPT*TAPSTS
TTPSRRSPSPSTPPSAGPATTAS*RPTSSKSSAPSTERDTTWPSAT*PRTGSWSRCWPTTTSATRASTCPRATRTACTPSSATSSP*AA
RSWTRSTTRTTRPSPWPTSTTTRASSATSRPPCARASPTPPTTPTRSSARAPSPASPRKSSSATGSCGASPSPATSCPWARSPTSARTC
STPTPPTR*T*ISKSTPWMSPPFSMLSSKSSTSSECTSPTAASSKPSTCARPSRPATPPPKPLLLLAR*RRAPASRSSGPSSATWAAGPA
SWAPSTSASLDSWPRTSWPAPS*TRPAARPGASTGWPSPGTRAPTHATSSTPSGSRTSASSRSTSSSTRACCVAAPWPPRTAASP
WKSPPRPCRVRARPPAGSSAACSCTPSCTGPTAPWTRTPP*TY*RGCPTACSSRPRWNPPCAATRKRSTASSMPTPPTFAPTARAS
RRPPPSTA*IKTCKKPVCVCECFIHNKQHMFMPPSLRL*LYLEIEGVLPALGMARGQGYVAELVLGQPLELGDQQLGHGEVGERVAP
QLARELQGAQQVGRGDLEIAVGTRVLRARVAVHGVAALEHHQGRVLHACQHRRVGDALHVQILGVGHPEGGHLAGLPPHAGHA
AGLVVAIAVQGDQHHLGLLGAHARVHGLHESLQLAEGLLRLAALGEEDPAGLARELVGGAAGVVHAAARVVVGQLHHAAPPAVL
GDLGPVGVLLQRALPVLARHIHLDSVLLLDHHGPVQAPQLALGFGAAVQPQRAAGALPVLVGDLGVRVHEALQEAAHHRGQGLV
AGEGQRDAAVLLVHIQVADAAVHLALLGHQLEGGLQVALHAVPVHQQRHHFHALLGPRNDRQAQGVLHRHCHLSRRRRGQGVV
LVQGLKHSLAVLLDDAHGGKAEAHGRQLLLGLPFVLAVLADVLQRHMLGLAGFLGRQRRRRCAGRARVLVHHDYFFFLAVVRDH
AAVGMPLLGQRRRRRALAVRRAAGRAPSAFGGALLAALL*LTSSAAGHCVLLGSNNKHGDSAIVANIAICPRRHRRREPAAE*KLNR
PAAQPHLRRRGPRHARDGGIHRD*PGLRDARGARGGAGSALFSPGREPPRAARAGSRERAEPGWARAWRLPERGRGRAHQASG
PPMHHRQGRAARPRRGAPQRGGAQPRLRAQPLLAARAPQAPAQRHL*AQPAPQLLPGLRGARGPGHLPPLFQEPKDPRLLPRQP
HPRRRPAQPGPRRPPT*YHLLGRGSQDLRGSGQRRDSGRERSARKRRGA*APQRPGGVGRRQRAPGGPQAHGRADPLRLPGAQ
PAPQGHERRHGPGAHQARLAPLGGGDAGPREFGRGQARGQRRAAGALAGSE*HPPEPGRAAQAHDGRGPGDRGAGVSAPLLC
RRGDPAQGRGEPALPLQARVRAPGLQDLQRGADQPGLLHGHPAREPPGAKRAAHHPARGGPPRLHPRLRLPVPLPHLADGHGRV

Fig. 21K

AAVPGGAEPERALQAPAEEPQGPVDRVRRAYHRLGPGRPHLPRAPAADAAQRAARLYEPKHVAKLSLFHPRTLRDPARHLLRAALG
LRAADLPRVPPAALEPLLLAAPGQLPGLPLGRDRGRQRRGSAGVPLPLQPLHAAPLPGLQPPAAERDPDHRHLRVARPRRRRGQG
GSETHPGAVDLGLLAQVRARGLPSLRDQVLRGPIPAAQGRAVGLRHHPGGHPGPIASHPEIPPRISAEKGPRGLLGPPDRRGAQPQ
LPPGCPEEAARS*KWSCRRRRIWRKTGRAVRQRRRRWKTGTALRQRRTACKTVWRRKTRWRRQRKKQPPPDRRPRRRKQAARIP
SPLRVGVAAAGPTVGGTRPGASRTPPPRPVRRSGRDTSPGGGTKTPSSPACKPAGATSPSPGATCSSTAG*TSPATSCITTVTSTAPT
TVSKKRQKPSSSRKPAAAAARKSTAAAGGLRIAANEPAQTRELRNRIFPTLYAIFQQSRGQEQELKVKNRSLRSLTRSCLYHKSEDQLQ
RTLEDAEALFNKYCALTLKE*PAPAHTRKKAGITSPPAPFARPS*AKRFPRLTCGATSPRWAWPPAPPRTTPPA*TGSVPGPR*SHG*
MTSAPTETRYS*NSQRSPPRPAITLIRVIGPPPWCTRKFPSPRPYYFRETPRPKSS*LTQVSSWPAAPPCVVTAPLRV*SGW*SEAEA
HSSTTRW*ALRWVCDLTESSNSPDRGDLPSRLVRPS*LWRVRPRSPARAASALSSSWRSSLPRSTSTPSPAPPATTRTSSSRTSTPSAS
RWTATIECPMVAQLT*LGFDTWTTAAASAASLGISPSLPTLSCPRSTLRAQPTECGSSSKGASTPTCFGSSASDRSWSSANKDRPFLL
CTASATTPACMKVFVVCCVLSIIKAEISDYSGLDCGVPAINRSLFFTGNETELQLQCKPHKKYLTWLFQGSPIAVVNHCDNDGVLLSGP
ANLTFSTRRSKLQLFQPFLPGTYQCVSGPCHHTFHLIPNTTAPLPATNNQTTHQRHRRDLSSESNTTTGGELRGRPTSGIYYGPWEVV
GLIANKKNNHLI*NKDTIILMI*V*QK*RITYLKSDTRSLSMFSANTTSLPSSQLWYCRPRRAANFLHTLKGMSNSSCPSIFILSSIRCPKS
ASGWMMTSTPSTPTMQTTHRPCPSSTPPSSLQMDSKRSPWGCCPCDWLTPSPPRTGKSPSSWERGWTSTRRENSSPTRPPRPPP
LSVFQTTPFPLKLLPLSTTTMEL*ASMSPHH*QYFPHLTL*A*VLETVFRLQISC*LYN*LILLHSAQIASQ*KQTKGYILTPVETEDLRLI*
A*KED*FLTVMLLQHILEMA*TMDLMIVMEKQDP*LPKLEQD*ILMLTKQ*LSN*AQV*VLTPLVP*QLETNRMTS*HFGLPLTQA
LIVNYFQTEMPNLLSVLQNAVVKY*ALWQWRLLL*DQH*IQLMTQSKAP*FSLDLIPMVYSCQTHQW*VITGTLGRDRPLKV*PIQ
MLWDSCQI*VHIQKPKVKHLKIA*SVRYI*LEKLLCQ*H*P*LSMALMKKTQPQLAPTL*LLHGSGLETIRTKILPLLPTHSLFPTSPRN
NPTQQANPFSHHLCLYGNSETEK*SSSVLLNQQFYRTRAVIFPPPSQDMEYTTLSPRTALNI*MPLVMDMLLVSTFHTVSERASLGS
VREMKPSGHSRICTSQLNS*GLSSVVGITVIWKKQKSGGGNHSPRTGSAGGVASGPAAVAAAAAPSSCCSGGSGPGTPSA*CPRPS
ASVVWCGGRSSACESRSGHCSTCNTGPPGCSTVHSSTRSSRNSSREGCYPRGRRTRSSGKSSGAPSRRRCPCT*SPWACGGSPPPG
TTSPSG*TCSPG*SCGTTGPAPPRPPCSEETPDPGNDNGGPTARTRGSSGS*TSLCWHSTGICSCISSALSAPRGSKPYPRARGTLAG
QRTPQNRAILAHNLHCAWTGYRNQAAPGDPPPEKRGSRSPHSVVRGPADTGDGGTRLIVFSTVS*CSCFRTFSYLL*QNLVRALHT
DRRRRSRRLERSVLKL*NSHSLRPCSRSRASGVMKIPSCLIALITSTTVEWARPSQMMQFCWVSVTAGEGRTGRTMINF*SKRSRST
SK*RSRRWHLSPPLCWWKITARSKVIRFSRCSTVASSKASTRTSRNKTIAKAGGFSNSSTIMLHSCTIPR*FSFFQP*MIRTSS*GKSKP
AMIKSSRRAPSTGILKHTLIIPRYSAPGSPAAD*QAEYQNLCRDP*APPSAITVSTLSYRLRNF*P*DPQE*EKGKPHYR*TEVPPSEHC
QM*D*NKHAG*TR*YLPDNWTENRVSNF*ENQQKKNLPGARLGPREQRWSKCKGCVPAWLVS*SVKKQKIKH*TMLAWRTGG
*IVLSSTRQATGSPARPS*KLSL*LKTITERRSRWPA*MIREEAYTPGTLESVSEKKRPRKQ*GTTTLTLKSSKAMPCG*STKFSGA*KM
*LLPSCTGSEAPDPSRYTYKASASIAYRAAAAAAHNRRKSQRKD*ALTCPPALCSIYSPRSTLT*RPKSKNTRQIITHAQHTPRNR*HTQ
KNTRTSSNGQTAVISGFPRYVIKTRLSNSVDR*KHHPPRP*RSPLPQPITFLPPQIQTAHLHINAHQKFEVYY**

Fig. 22A

AdC7 010-HIVgp140(E1469) Nucleic Acids – SEQ ID NO: 3

```
CATCATCAATAATATACCTCAAACTTTTGGTGCGCGTTAATATGCAAATGAGCTGTTTGAATTTGGGGAGGGAGGAAGGTGAT
TGGCCGAGAGACGGGCGACCGTTAGGGGCGGGGCGGGTGACGTTTTGATGACGTGGCCGTGAGGCGGAGCCGGTTTGCAA
GTTCTCGTGGGAAAAGTGACGTCAAACGAGGTGTGGTTTGAACACGGAAATACTCAATTTTCCCGCGCTCTCTGACAGGAAAT
GAGGTGTTTCTGGGCGGATGCAAGTGAAAACGGGCCATTTTCGCGCGAAAACTGAATGAGGAAGTGAAAATCTGAGTAATTT
CGCGTTTATGGCAGGGAGGAGTATTTGCCGAGGGCCGAGTAGACTTTGACCGATTACGTGGGGGTTTCGATTACCGTATTTTT
CACCTAAATTTCCGCGTACGGTGTCAAAGTCCGGTGTTTTTACGTACGATATCATTTCCCCGAAAGTGCCACCTGACCGTAACTA
TAACGGTCCTAAGGTAGCGAAAGCTCAGATCTCCCGATCCCCTATGGTGCACTCTCAGTACAATCTGCTCTGATGCCGCATAGT
TAAGCCAGTATCTGCTCCCTGCTTGTGTGTTGGAGGTCGCTGAGTAGTGCGCGAGCAAAATTTAAGCTACAACAAGGCAAGGC
TTGACCGACAATTGCATGAAGAATCTGCTTAGGGTTAGGCGTTTTGCGCTGCTTCGCGATGTACGGGCAGATATACGCGTTG
ACATTGATTATTGACTAGTATGCCAAGTACGCCCCTATTGACGTCAATGACGGTAAATGGCCCGCCTGGCATTATGCCCAGTA
CATGACCTTATGGGACTTTCCTACTTGGCAGTACATCTACGTATTAGTCATCGCTATTACCATGGTGATGCGGTTTTGGCAGTAC
ATCAATGGGCGTGGATAGCGGTTTGACTCACGGGGATTTCCAAGTCTCCACCCCATTGACGTCAATGGGAGTTTGTTTTGGCA
CCAAAATCAACGGGACTTTCCAAAATGTCGTAACAACTCCGCCCCATTGACGCAAATGGGCGGTAGGCGTGTACGGTGGGAG
GTCTATATAAGCAGAGCTCGTTTAGTGAACCGTCAGATCACTAGAAGCTTTATTGCGGTAGTTTATCACAGTTAAATTGCTAAC
GCAGTCAGTGCTTCTGACACAACAGTCTCGAACTTAAGGCTAGAGTACTTAATACGACTCACTATAGGCTAGTTAAGGCTAGA
GTTCGACGCCACCATGCGCGTGATGGGCATCCTGCGCTCCTACCAGCAGTGGTGGATCTGGGGCATCCTGGGCTTCTGGATGC
TGATGATCTGCAACGTGTGGGGCAACCTGTGGGTGACCGTGTACTACGGCGTGCCCGTGTGGAAGGAGGCCAAGACCACCCT
GTTCTGCGCCTCCGACGCCAAGGCCCACAAGGAGGAGGTGCACAACATCTGGGCCACCCACGCCTGCGTGCCCACCGACCCCA
ACCCCCAGGAGATCGTGCTGAAGAACGTGACCGAGAACTTCAACATGTGGAAGAACGACATGGTGGACCAGATGCACGAGG
ACATCATCTCCCTGTGGGACCAGTCCCTGAAGCCCTGCGTGAAGCTGACCCCCCTGTGCGTGACCCTGAACTGCTCCGACGTGA
AGATCAAGGGCACCAACGCCACCTACAACAACGCCACCTACAACAACAACAACACCATCTCCGACATGAAGAACTGCTCCTTCA
ACACCACCACCGAGATCACCGACAAGAAGAAGAAGGAGTACGCCCTGTTCTACAAGCTGGACGTGGTGGCCCTGGACGGCAA
GGAGACCAACTCCACCAACTCCTCCGAGTACCGCCTGATCAACTGCAACACCTCCGCCGTGACCCAGGCCTGCCCCAAGGTGTC
CTTCGACCCCATCCCCATCCACTACTGCGCCCCCGCCGGCTACGCCATCCTGAAGTGCAACAACAAGACCTTCAACGGCACCGG
CCCCTGCAACAACGTGTCCACCGTGCAGTGCACCCACGGCATCAAGCCCGTGGTGTCCACCCAGCTGCTGCTGAACGGCTCCCT
GGCCGAGGAGGAGGTGGTGATCCGCTTCGAGAACCTGACCAACAACGCCAAGATCATCATCGTGCACCTGAACGAGTCCGTG
GAGATCAACTGCACCCGCCCCTCCAACAACACCCGCAAGTCCGTGCGCATCGGCCCCGGCCAGACCTTCTTCGCCACCGGCGA
CATCATCGGCGACATCCGCCAGGCCCACTGCAACATCTCCCGCAAGAAGTGGAACACCACCCTGCAGCGCGTGAAGGAGAAG
CTGAAGGAGAAGTTCCCCAACAAGACCATCCAGTTCGCCCCCTCCTCCGGCGGCGACCTGGAGATCACCACCCACTCCTTCAAC
TGCCGCGGCGAGTTCTTCTACTGCTACACCTCCGACCTGTTCAACTCCACCTACATGTCCAACAACACCGGCGGCGCCAACATC
ACCCTGCAGTGCCGCATCAAGCAGATCATCCGCATGTGGCAGGGCGTGGGCCAGGCCATGTACGCCCCCCCCATCGCCGGCA
ACATCACCTGCAAGTCCAACATCACCGGCCTGCTGCTGACCCGCGACGGCGGCAAGGAGAAGAACGACACCGAGACCTTCCG
CCCCGGCGGCGGCGACATGCGCGACAACTGGCGCTCCGAGCTGTACAAGTACAAGGTGGTGGAGATCAAGCCCCTGGGCATC
GCCCCCGACAAGGCCAAGCTGACCGTGCAGGCCCGCCAGCTGCTGTCCGGCATCGTGCAGCAGCAGTCCAACCTGCTGCGCG
CCATCGAGGCCCAGCAGCACATGCTGCAGCTGACCGTGTGGGGCATCAAGCAGCTGCAGACCCGCGTGCTGGCCATCGAGCG
CTACCTGAAGGACCAGCAGCTGCTGGGCATCTGGGGCTGCTCCGGCAAGCTGATCTGCACCACCGCCGTGCCCTGGAACGCCT
CCTGGTCCAACAAGTCCTACGAGGAGATCTGGGGCAACATGACCTGGATGCAGTGGGACCGCGAGATCAACAACTACACCAA
CACCATCTACTCCCTGCTGGAGGAGTCCCAGAACCAGCAGGAGAAGAACGAGAAGGACCTGCTGGCCCTGGACTCCTGGGAG
TCCCTGTGGTCCTGGTTCAACATCACCAACTGGCTGTGGTAAGGTACCTCTAGAGTCGACCCGGGCGGCCAAACCGCTGATCA
GCCTCGACTGTGCCTTCTAGTTGCCAGCCATCTGTTGTTTGCCCCTCCCCCGTGCCTTCCTTGACCCTGGAAGGTGCCACTCCCA
CTGTCCTTTCCTAATAAAATGAGGAAATTGCATCGCATTGTCTGAGTAGGTGTCATTCTATTCTGGGGGGTGGGGTGGGGCAG
GACAGCAAGGGGGAGGATTGGGAAGACAATAGCAGGCATGCTGGGGATGCGGTGGGCTCTATGGCTTCTGAGGCGGAAAG
AACCAGCAGATCTGCAGATCTGAATTCATCTATGTCGGGTGCGGAGAAGAGGTAATGAAATGGCATTATGGGTATTATGGG
TCTGCATTAATGAATCGGCCAGATATCGATATGCTGGCCACCGTGCATGTGACCTCGCACCCCCGCAAGACATGGCCCGAGTTC
GAGCACAACGTCATGACCCGATGCAATGTGCACCTGGGGTCCCGCCGAGGCATGTTCATGCCCTACCAGTGCAACATGCAATT
TGTGAAGGTGCTGCTGGAGCCCGATGCCATGTCCAGAGTGAGCCTGACGGGGGTGTTTGACATGAATGTGGAGCTGTGGAAA
ATTCTGAGATATGATGAATCCAAGACCAGGTGCCGGGCCTGCGAATGCGGAGGCAAGCACGCCAGGCTTCAGCCCGTGTGTG
TGGAGGTGACGGAGGACCTGCCGACCCGATCATTTGGTGTTGTCCTGCAACGGGACGGAGTTCGGCTCCAGCGGGGAAGAATC
```

Fig. 22B

```
TGACTAGAGTGAGTAGTGTTTGGGGGAGGTGGAGGGCTTGTATGAGGGGCAGAATGACTAAAATCTGTGTTTTTCTGTGTGT
TGCAGCAGCATGAGCGGAAGCGCCTCCTTTGAGGGAGGGGTATTCAGCCCTTATCTGACGGGGCGTCTCCCCTCCTGGGCGG
GAGTGCGTCAGAATGTGATGGGATCCACGGTGGACGGCCGGCCCGTGCAGCCCGCGAACTCTTCAACCCTGACCTACGCGAC
CCTGAGCTCCTCGTCCGTGGACGCAGCTGCCGCCGCAGCTGCTGCTTCCGCCGCCAGCGCCGTGCGCGGAATGGCCCTGGGC
GCCGGCTACTACAGCTCTCTGGTGGCCAACTCGACTTCCACCAATAATCCCGCCAGCCTGAACGAGGAGAAGCTGCTGCTGCT
GATGGCCCAGCTCGAGGCCCTGACCCAGCGCCTGGGCGAGCTGACCCAGCAGGTGGCTCAGCTGCAGGCGGAGACGCGGGC
CGCGGTTGCCACGGTGAAAACCAAATAAAAAATGAATCAATAAATAAACGGAGACGGTTGTTGATTTTAACACAGAGTCTTGA
ATCTTTATTTGATTTTTCGCGCGCGGTAGGCCCTGGACCACCGGTCTCGATCATTGAGCACCCGGTGGATTTTTTCCAGGACCC
GGTAGAGGTGGGCTTGGATGTTGAGGTACATGGGCATGAGCCCGTCCCGGGGGTGGAGGTAGCTCCATTGCAGGGCCTCGT
GCTCGGGGGTGGTGTTGTAAATCACCCAGTCATAGCAGGGGCGCAGGGCGTGGTGCTGCACGATGTCCTTGAGGAGGAGAC
TGATGGCCACGGGCAGCCCCTTGGTGTAGGTGTTGACGAACCTGTTGAGCTGGGAGGGATGCATGCGGGGGAGATGAGAT
GCATCTTGGCCTGGATCTTGAGATTGGCGATGTTCCCGCCCAGATCCCGCCGGGGTTCATGTTGTGCAGGACCACCAGCACG
GTGTATCCGGCGCACTTGGGGAATTTGTCATGCAACTTGGAAGGGAAGGCGTGAAAGAATTTGGAGACGCCCTTGTGACCGC
CCAGGTTTTCCATGCACTCATCCATGATGATGGCGATGGGCCCGTGGGCGGCGGCCTGGGCAAAGACGTTTCGGGGGTCGGA
CACATCGTAGTTGTGGTCCTGGGTGAGCTCGTCATAGGCCATTTTAATGAATTTGGGGCGGAGGGTGCCCGACTGGGGACG
AAGGTGCCCTCGATCCCGGGGGCGTAGTTGCCCTCGCAGATCTGCATCTCCCAGGCCTTGAGCTCGGAGGGGGGATCATGT
CCACCTGCGGGGCGATGAAAAAAACGGTTTCCGGGGCGGGGAGATGAGCTGGGCCGAAAGCAGGTTCCGGAGCAGCTGG
GACTTGCCGCAGCCGGTGGGGCCGTAGATGACCCCGATGACCGGCTGCAGGTGGTAGTTGAGGGAGAGACAGCTGCCGTCC
TCGCGGAGGAGGGGGGCCACCTCGTTCATCATCTCGCGCACATGCATGTTCTCGCGCACGAGTTCCGCCAGGAGGCGCTCGCC
CCCCAGCGAGAGGAGCTCTTGCAGCGAGGCGAAGTTTTTCAGCGGCTTGAGYCCGTCGGCCATGGGCATTTTGGAGAGGGTC
TGTTGCAAGAGTTCCAGACGGTCCCAGAGCTCGGTGATGTGCTCTAGGGCATCTCGATCCAGCAGACCTCCTCGTTTCGCGGG
TTGGGGCGACTGCGGGAGTAGGGCACCAGGCGATGGGCGTCCAGCGAGGCCAGGGTCCGGTCCTTCCAGGGTCGCAGGGTC
CGCGTCAGCGTGGTCTCCGTCACGGTGAAGGGGTGCGCGCCGGGCTGGGCGCTTGCGAGGGTGCGCTTCAGGCTCATCCGGC
TGGTCGAGAACCGCTCCCGGTCGGCGCCCTGCGCGTCGGCCAGGTAGCAATTGAGCATGAGTTCGTAGTTGAGCGCCTCGGC
CGCGTGGCCCTTGGCGCGGAGCTTACCTTTGGAAGTGTGTCCGCAGACGGGACAGAGGAGGGACTTGAGGGCGTAGAGCTT
GGGGGCGAGGAAGACGGACTCGGGGGCGTAGGCGTCCGCGCCGCAGCTGGCGCAGACGGTCTCGCACTCCACGAGCCAGG
TGAGGTCGGGCCGGTTGGGGTCAAAAACGAGGTTTCCTCCGTGCTTTTTGATGCGTTTCTTACCTCTGGTCTCCATGAGCTCGT
GTCCCCGCTGGGTGACAAAGAGGCTGTCCGTGTCCCGTAGACCGACTTTATGGGCCGGTCCTCGAGCGGGGTGCCGCGGTC
CTCGTCGTAGAGGAACCCCGCCCACTCCGAGACGAAGGCCCGGGTCCAGGCCAGCACGAAGGAGGCCACGTGGGAGGGGTA
GCGGTCGTTGTCCACCAGCGGGTCCACCTTCTCCAGGGTATGCAAGCACATGTCCCCCTCGTCCACATCCAGGAAGGTGATTG
GCTTGTAAGTGTAGGCCACGTGACCGGGGGTCCCGGCCGGGGGGTATAAAAGGGGCGGGCCCCTGCTCGTCCTCACTGTC
TTCCGGATCGCTGTCCAGGAGCGCCAGCTGTTGGGGTAGGTATTCCCTCTCGAAGGCTGGCATAACCTCGGCACTCAGGTTGT
CAGTTTCTAGAAACGAGGAGGATTTGATATTGACGGTGCCGTTGGAGACGCCTTTCATGAGCCCCTCGTCCATCTGGTCAGAA
AAGACGATCTTTTTGTTGTCGAGCTTGGTGGCGAAGGAGCCGTAGAGGGCGTTGGAGAGGAGCTTGGCGATGGAGCGCATG
GTCTGGTTCTTTTCCTTGTCGGCGCGCTCCTTGGCGGCGATGTTGAGCTGCACGTACTCGCGCGCCACGCACTTCCATTCGGGG
AAGACGGTGGTGAGCTCGTCGGGCACGATTCTGACCCGCCAGCCGCGGTTGTGCAGGGTGATGAGGTCCACGCTGGTGGCCA
CCTCGCCGCGCAGGGGCTCGTTGGTCCAGCAGAGGCGCCCGCCCTTGCGCGAGCAGAAGGGGGGCAGCGGGTCCAGCATGA
GCTCGTCGGGGGGTCGGCGTCCACGGTGAAGATGCCGGGCAGAAGCTCGGGGTCGAAGTAGCTGATGCAGGTGTCCAGAT
CGTCCAGCGCCGCTTGCCAGTCGCGCACGGCCAGCGCGCGCTCGTAGGGGCTGAGGGGCGTGCCCAGGGCATGGGGTGCG
TGAGCGCGGAGGCGTACATGCCGCAGATGTCGTAGACGTAGAGGGCTCCTCGAGGACGCCGATGTAGGTGGGGTAGCAGC
GCCCCCCGCGGATGCTGGCGCGCACGTAGTCGTACAGCTCGTGCGAGGGCGCGAGGAGCCCCGTGCCGAGGTTGGAGCGTT
GCGGCTTTTCGGCGCGGTAGACGATCTGGCGGAAGATGGCGTGGGAGTTGGAGGAGATGGTGGGCCTCTGGAAGATGTTGA
AGTGGGCGTGGGGCAGGCCGACCGAGTCCCTGATGAAGTGGGCGTAGGAGTCCTGCAGCTTGGCGACGAGCTCGGCGGTGA
CGAGGACGTCCAGGGCGCAGTAGTCGAGGGTCTCTTGGATGATGTCGTACTTGAGCTGGCCCTTCTGCTTCCACAGCTCGCGG
TTGAGAAGGAACTCTTCGCGGTCCTTCCAGTACTCTTCGAGGGGAACCCGTCCTGATCGGCACGGTAAGAGCCCACCATGTA
GAACTGGTTGACGGCCTTGTAGGCGCAGCAGCCCTTCTCCACGGGGAGGGCGTAAGCTTGTGCGGCCTTGCGCAGGGAGGTG
TGGGTGAGGGCGAAGGTGTCGCGCACCATGACCTTGAGGAACTGGTGCTTGAAGTCGAGGTCGTCGCAGCCGCCCTGCTCCC
AGAGCTGGAAGTCCGTGCGCTTCTTGTAGGCGGGGTTGGGCAAAGCGAAAGTAACATCGTTGAAGAGGATCTTGCCCGCGCG
GGGCATGAAGTTGCGAGTGATGCGGAAAGGCTGGGCACCTCGGCCCGGTTGTTGATGACCTGGGCGGCGAGGACGATCTC
GTCGAAGCCGTTGATGTTGTGCCCGACGATGTAGAGTTCCACGAATCGCGGGCGGCCCTTAACGTGGGGCAGCTTCTTGAGCT
CGTCGTAGGTGAGCTCGGCGGGGTCGCTGAGCCCGTGCTGCTCGAGGGCCCAGTCGGCGACGTGGGGGTTGGCGCTGAGGA
```

Fig. 22C

```
AGGAAGTCCAGAGATCCACGGCCAGGGCGGTCTGCAAGCGGTCCCGGTACTGACGGAACTGCTGGCCCACGGCCATTTTTTC
GGGGGTGACGCAGTAGAAGGTGCGGGGGTCGCCGTGCCAGCGGTCCCACTTGAGCTGGAGGGCGAGGTCGTGGGCGAGCT
CGACGAGCGGCGGGTCCCCGGAGAGTTTCATGACCAGCATGAAGGGGACGAGCTGCTTGCCGAAGGACCCCATCCAGGTGT
AGGTTTCCACATCGTAGGTGAGGAAGAGCCTTTCGGTGCGAGGATGCGAGCCGATGGGGAAGAACTGGATCTCCTGCCACCA
GTTGGAGGAATGGCTGTTGATGTGATGGAAGTAGAAATGCCGACGGCGCGCCGAGCACTCGTGCTTGTGTTTATACAAGCGT
CCGCAGTGCTCGCAACGCTGCACGGGATGCACGTGCTGCACGAGCTGTACCTGGGTTCCTTTGACGAGGAATTTCAGTGGGCA
GTGGAGCGCTGGCGGCTGCATCTGGTGCTGTACTACGTCCTGGCCATCGGCGTGGCCATCGTCTGCCTCGATGGTGGTCATGC
TGACGAGCCCGCGCGGGAGGCAGGTCCAGACTTCGGCTCGGACGGGTCGGAGAGCGAGGACGAGGGCGCGCAGGCCGGAG
CTGTCCAGGGTCCTGAGACGCTGCGGAGTCAGGTCAGTGGGCAGCGGCGGCGCGCGGTTGACTTGCAGGAGCTTTTCCAGG
GCGCGCGGGAGGTCCAGATGGTACTTGATCTCCACGGCGCCGTTGGTGGCGACGTCCACGGCTTGCAGGGTCCCGTGCCCCT
GGGGCGCCACCACCGTGCCCCGTTTCTTCTTGGGCGCTGCTTCCATGCCGGTCAGAAGCGGCGGCGAGGACGCGCGCCGGGC
GGCAGGGCGGCTCGGGACCCGGAGGCAGGGGCGGCAGGGGCACGTCGGCGCCGCGCGCGGGCAGGTTCTGGTACTGCGC
CCGGAGAAGACTGGCGTGAGCGACGACGCGACGGTTGACGTCCTGGATCTGACGCCTCTGGGTGAAGGCCACGGGACCCGT
GAGTTTGAACCTGAAAGAGAGTTCGACAGAATCAATCTCGGTATCGTTGACGGCGGCCTGCCGCAGGATCTCTTGCACGTCGC
CCGAGTTGTCCTGGTAGGCGATCTCGGTCATGAACTGCTCGATCTCCTCCTCCTGAAGGTCTCCGCGGCCGGCGCGCTCGACG
GTGGCCGCGAGGTCGTTGGAGATGCGGCCCATGAGCTGCGAGAAGGCGTTCATGCCGGCCTCGTTCCAGACGCGGCTGTAGA
CCACGGCTCCGTCGGGGTCGCGCGCGCGCATGACCACCTGGGCGAGGTTGAGCTCGACGTGGCGCGTGAAGACCGCGTAGTT
GCAGAGGCGCTGGTAGAGGTAGTTGAGCGTGGTGGCGATGTGCTCGGTGACGAAGAAGTACATGATCCAGCGGCGGAGCG
GCATCTCGCTGACGTCGCCCAGGGCTTCCAAGCGCTCCATGGCCTCGTAGAAGTCCACGGCGAAGTTGAAAAACTGGGAGTTG
CGCGCCGAGACGGTCAACTCCTCCTCCAGAAGACGGATGAGCTCAGCGATGGTGGCGCGCACCTCGCGCTCGAAGGCCCCGG
GGGGCTCCTCTTCTTCCATCTCTTCCTCCTCCACTAACATCTCTTCTACTTCCTCCTCAGGAGGCGGCGGCGGGGAGGGGCCCT
GCGTCGCCGGCGGCGCACGGGCAGACGGTCGATGAAGCGCTCGATGGTCTCCCCGCGCCGGCGACGCATGGTCTCGGTGAC
GGCGCGCCCGTCCTCGCGGGGCCGCAGCGTGAAGACGCCGCCGCGCATCTCCAGGTGGCCGCCGGGGGGTCTCCGTTGGG
CAGGGAGAGGGCGCTGACGATGCATCTTATCAATTGGCCCGTAGGGACTCCGCGCAAGGACCTGAGCGTCTCGAGATCCACG
GGATCCGAAAACCGCTGAACGAAGGCTTCGAGCCAGTCGCAGTCGCAAGGTAGGCTGAGCCCGGTTTCTTGTTCTTCGGGGA
TTTCGGGAGGCGGGCGGGCGATGCTGCTGGTGATGAAGTTGAAGTAGGCGGTCCTGAGACGGCGGATGGTGGCGAGGAGC
ACCAGGTCCTTGGGCCCGGCTTGCTGGATGCGCAGACGGTCGGCCATGCCCAGGCGTGGTCCTGACACCTGGCGAGGTCCT
TGTAGTAGTCCTGCATGAGCCGCTCCACGGGCACCTCCTCCTCGCCCGCGCGGCCGTGCATGCGCGTGAGCCCGAACCCGCGC
TGGGGCTGGACGAGCGCCAGGTCGGCGACGACGCGCTCGGCGAGGATGGCCTGCTGTATCGGGTGAGGGTGGTCTGGAAG
TCGTCGAAGTCGACGAAGCGGTGGTAGGCTCCGGTGTTGATGGTATAGGAGCAGTTGGCCATGACGGACCAGTTGACGGTCT
GGTGGCCGGGTCGCACGAGCTCGTGGTACTTGAGGCGCGAGTAGGCGCGCGTGTCGAAGATGTAGTCGTTGCAGGTGCGCA
CGAGGTACTGGTATCCGACGAGGAAGTGCGGCGGCGGCTGGCGGTAGAGCGGCCATCGCTCGGTGGCGGGGCGCCGGGC
GCGAGGTCCTCGAGCATGAGGCGGTGGTAGCCGTAGATGTACCTGGACATCCAGGTGATGCCGGCGGCGGTGGTGGAGGCG
CGCGGGAACTCGCGGACGCGGTTCCAGATGTTGCGCAGCGGCAGGAAGTAGTTCATGGTGGCCGCGGTCTGGCCCGTGAGG
CGCGCGCAGTCGTGGATGCTCTAGACATACGGGCAAAAACGAAAGCGGTCAGCGGCTCGACTCCGTGGCCTGGAGGCTAAGC
GAACGGGTTGGGCTGCGCGTGTACCCCGGTTCGAATCTCGAATCAGGCTGGAGCCGCAGCTAACGTGGTACTGGCACTCCCG
TCTCGACCCAAGCCTGCTAACGAAACCTCCAGGATACGGAGGCGGGTCGTTTTTGGCCTTGGTCGCTGGTCATGAAAAACTA
GTAAGCGCGGAAAGCGACCGCCCGCGATGGCTCGCTGCCGTAGTCTGGAGAAAGAATCGCCAGGGTTGCGTTGCGGTGTGCC
CCGGTTCGAGCCTCAGCGCTCGGCGCCGGCCGGATTCCGCGGCTAACGTGGGCGTGGCTGCCCCGTCGTTTCCAAGACCCCTT
AGCCAGCCGACTTCTCCAGTTACGGAGCGAGCCCCTCTTTTTCTTGTGTTTTTGCCAGATGCATCCCGTACTGCGGCAGATGCG
CCCCCACCCTCCACCTCAACCGCCCCTACCGCCGCAGCAGCAGCAACAGCCGGCGCTTCTGCCCCCGCCCCAGCAGCAGCCAGC
CACTACCGCGGCGGCCGCCGTGAGCGGAGCCGGCGTTCAGTATGACCTGGCCTTGGAAGAGGGCGAGGGGCTGGCGCGGCT
GGGGGCGTCGTCGCCGGAGCGGCACCCGCGCGTGCAGATGAAAAGGGACGCTCGCGAGGCCTACGTGCCCAAGCAGAACCT
GTTCAGAGACAGGAGCGGCGAGGAGCCCGAGGAGATGCGCGCCTCCCGCTTCCACGCGGGGCGGGAGCTGCGGCGCGGCCT
GGACCGAAAGCGGGTGCTGAGGGACGAGGATTTCGAGGCGGACGAGCTGACGGGGATCAGCCCCGCGCGCGCACGTGG
CCGCGGCCAACCTGGTCACGGCGTACGAGCAGACCGTGAAGGAGGAGAGCAACTTCCAAAAATCCTTCAACAACCACGTGCG
CACGCTGATCGCGCGCGAGGAGGTGACCCTGGGCCTGATGCACCTGTGGGACCTGCTGGAGGCCATCGTGCAGAACCCCACG
AGCAAGCCGCTGACGGCGCAGCTGTTTCTGGTGGTGCAGCACAGTCGGGACAACGAGACGTTCAGGGAGGCGCTGCTGAAT
ATCACCGAGCCCGAGGGCCGCTGGCTCCTGGACCTGGTGAACATTCTGCAGAGCATCGTGGTGCAGGAGCGCGGGCTGCCGC
TGTCCGAGAAGCTGGCGGCTATCAACTTCTCGGTGCTGAGCCTGGGCAAGTACTACGCTAGGAAGATCTACAAGACCCCGTAC
GTGCCCATAGACAAGGAGGTGAAGATCGACGGGTTTTACATGCGCATGACCCTGAAAGTGCTGACCCTGAGCGACGATCTGG
```

Fig. 22D

```
GGGTGTACCGCAACGACAGGATGCACCGCGCGGTGAGCGCCAGCCGCCGGCGCGAGCTGAGCGACCAGGAGCTGATGCACA
GCCTGCAGCGGGCCCTGACCGGGGCCGGGACCGAGGGGGAGAGCTACTTTGACATGGGCGCGGACCTGCGCTGGCAGCCCA
GCCGCCGGGCCTTGGAAGCTGCCGGCGGTTCCCCCTACGTGGAGGAGGTGGACGATGAGGAGGAGGAGGGCGAGTACCTG
GAAGACTGATGGCGCGACCGTATTTTTGCTAGATGCAGCAACAGCCACCGCCTCCTGATCCCGCGATGCGGGCGGCGCTGCA
GAGCCAGCCGTCCGGCATTAACTCCTCGGACGATTGGACCCAGGCCATGCAACGCATCATGGCGCTGACGACCCGCAATCCCG
AAGCCTTTAGACAGCAGCCTCAGGCCAACCGGCTCTCGGCCATCCTGGAGGCCGTGGTGCCCTCGCGCTCGAACCCCACGCAC
GAGAAGGTGCTGGCCATCGTGAACGCGCTGGTGGAGAACAAGGCCATCCGCGGCGACGAGGCCGGGCTGGTGTACAACGCG
CTGCTGGAGCGCGTGGCCCGCTACAACAGCACCAACGTGCAGACGAACCTGGACCGCATGGTGACCGACGTGCGCGAGGCG
GTGTCGCAGCGCGAGCGGTTCCACCGCGAGTCGAACCTGGGCTCCATGGTGGCGCTGAACGCCTTCCTGAGCACGCAGCCCG
CCAACGTGCCCCGGGGCCAGGAGGACTACACCAACTTCATCAGCGCGCTGCGGCTGATGGTGGCCGAGGTGCCCCAGAGCGA
GGTGTACCAGTCGGGGCCGGACTACTTCTTCCAGACCAGTCGCCAGGGCTTGCAGACCGTGAACCTGAGCCAGGCTTTCAAGA
ACTTGCAGGGACTGTGGGGCGTGCAGGCCCCGGTCGGGGACCGCGCGACGGTGTCGAGCCTGCTGACGCCGAACTCGCGCC
TGCTGCTGCTGCTGGTGGCGCCCTTCACGGACAGCGGCAGCGTGAGCCGCGACTCGTACCTGGGCTACCTGCTTAACCTGTAC
CGCGAGGCCATCGGGCAGGCGCACGTGGACGAGCAGACCTACCAGGAGATCACCCACGTGAGCCGCGCGCTGGGCCAGGAG
GACCCGGGCAACCTGGAGGCCACCCTGAACTTCCTGCTGACCAACCGGTCGCAGAAGATCCCGCCCCAGTACGCGCTGAGCAC
CGAGGAGGAGCGCATCCTGCGCTACGTGCAGCAGAGCGTGGGGCTGTTCCTGATGCAGGAGGGGGCCACGCCCAGCGCCGC
GCTCGACATGACCGCGCGCAACATGGAGCCCAGCATGTACGCTCGCAACCGCCCGTTCATCAATAAGCTGATGGACTACTTGC
ATCGGGCGGCCGCCATGAACTCGGACTACTTTACCAACGCCATCTTGAACCCGCACTGGCTCCCGCCGCCCGGGTTCTACACG
GGCGAGTACGACATGCCCGACCCCAACGACGGGTTCCTGTGGGACGACGTGGACAGCAGCGTGTTCTCGCCGCGCCCCGCCA
CCACCGTGTGGAAGAAAGAGGGCGGGGACCGGCGGCCGTCCTCGGCGCTGTCCGGTCGCGCGGGTGCTGCCGCGGCGGTGC
CTGAGGCCGCCAGCCCCTTCCCGAGCCTGCCCTTTTCGCTGAACAGCGTGCGCAGCAGCGAGCTGGGTCGGCTGACGCGGCC
GCGCCTGCTGGGCGAGGAGGAGTACCTGAACGACTCCTTGTTGAGGCCCGAGCGCGAGAAGAACTTCCCCAATAACGGGATA
GAGAGCCTGGTGGACAAGATGAGCCGCTGGAAGACGTACGCGCACGAGCACAGGGACGAGCCCCGAGCTAGCAGCAGCGC
AGGCACCCGTAGACGCCAGCGACACGACAGGCAGCGGGGTCTGGTGTGGGACGATGAGGATTCCGCCGACGACAGCAGCGT
GTTGGACTTGGGTGGGAGTGGTGGTGGTAACCCGTTCGCTCACTTGCGCCCCCGTATCGGGCGCCTGATGTAAGAATCTGAAA
AAATAAAAAACGGTACTCACCAAGGCCATGGCGACCAGCGTGCGTTCTTCTCTGTTGTTTGTAGTAGTATGATGAGGCGCGTG
TACCCGGAGGGTCCTCCTCCCTCGTACGAGAGCGTGATGCAGCAGGCGGTGGCGGCGGCGATGCAGCCCCCGCTGGAGGCG
CCTTACGTGCCCCGCGGTACCTGGCGCCTACGGAGGGGCGGAACAGCATTCGTTACTCGGAGCTGGCACCCTTGTACGATAC
CACCCGGTTGTACCTGGTGGACAACAAGTCGGCGGACATCGCCTCGCTGAACTACCAGAACGACCACAGCAACTTCCTGACCA
CCGTGGTGCAGAACAACGATTTCACCCCCACGGAGGCCAGCACCCAGACCATCAACTTTGACGAGCGCTCGCGGTGGGGCGG
CCAGCTGAAAACCATCATGCACACCAACATGCCCAACGTGAACGAGTTCATGTACAGCAACAAGTTCAAGGCGCGGGTGATG
GTCTCGCGCAAGACCCCCAATGGGGTCGCGGTGGATGAGAATTATGATGGTAGTCAGGACGAGCTGACTTACGAGTGGGTGG
AGTTTGAGCTGCCCGAGGGCAACTTCTCGGTGACCATGACCATCGATCTGATGAACAACGCCATCATCGACAACTACTTGGCG
GTGGGGCGTCAGAACGGGGTGCTGGAGAGCGACATCGGCGTGAAGTTCGACACGCGCAACTTCCGGCTGGGCTGGGACCCC
GTGACCGAGCTGGTGATGCCGGGCGTGTACACCAACGAGGCCTTCCACCCCGACATCGTCCTGCTGCCCGGCTGCGGCGTGG
ACTTCACCGAGAGCCGCCTCAGCAACCTGCTGGGCATCCGCAAGCGGCAGCCCTTCCAGGAGGGCTTCCAGATCCTGTACGAG
GACCTGGAGGGGGCAACATCCCCGCGCTCTTGGATGTCGAAGCCTATGAGAAAAGCAAGGAGGAGGCCGCCGCAGCGGCG
ACCGCAGCCGTGGCCACCGCCTCTACCGAGGTGCGGGGCGATAATTTTGCTAGCGCCGCGGCAGTGGCCGAGGCGGCTGAAA
CCGAAAGTAAGATAGTCATCCAGCCGGTGGAGAAGGACAGCAAGGACAGGAGCTACAACGTGCTCGCGGACAAGAAAAACA
CCGCCTACCGCAGCTGGTACCTGGCCTACAACTACGGCGACCCCGAGAAGGGCGTGCGCTCCTGGACGCTGCTCACCACCTCG
GACGTCACCTGCGGCGTGGAGCAAGTCTACTGGTCGCTGCCCGACATGATGCAAGACCCGGTCACCTTCCGCTCCACGCGTCA
AGTTAGCAACTACCCGGTGGTGGGCGCCGAGCTCCTGCCCGTCTACTCCAAGAGCTTCTTCAACGAGCAGGCCGTCTACTCGC
AGCAGCTGCGCGCCTTCACCTCGCTCACGCACGTCTTCAACCGCTTCCCCGAGAACCAGATCCTCGTCCGCCCGCCCGCGCCCA
CCATTACCACCGTCAGTGAAAACGTTCCTGCTCTCACAGATCACGGGACCCTGCCGCTGCGCAGCAGTATCCGGGGAGTCCAG
CGCGTGACCGTCACTGACGCCAGACGCCGCACCTGCCCCTACGTCTACAAGGCCCTGGGCGTAGTCGCCGCGCGTCCTCTC
GAGCCGCACCTTCTAAAAAATGTCCATTCTCATCTCGCCCAGTAATAACACCGGTTGGGGCCTGCGCGCGCCCAGCAAGATGT
ACGGAGGCGCTCGCCAACGCTCCACGCAACACCCGTGCGCGTGCGCGGGCACTTCCGCGCTCCCTGGGGCGCCCTCAAGGG
CCGCGTGCGCTCGCGCACCACCGTCGACGACGTGATCGACCAGGTGGTGGCCGACGCGCGCAACTACACGCCCGCCGCCGCG
CCCGCCTCCACCGTGGACGCCGTCATCGACAGCGTGGTGGCCGATGCGCGCCGGTACGCCCGCGCCAAGAGCCGGCGGCGGC
GCATCGCCCGGCGGCACCGGAGCACCCCCGCCATGCGCGCGGCGCGAGCCTTGCTGCGCAGGGCCAGGCGCACGGGACGCA
GGGCCATGCTCAGGGCGGCCAGACGCGCGGCCTCCGGCAGCAGCAGCGCCGGCAGGACCCGCAGACGCGCGGCCACGGCG
```

Fig. 22E

```
GCGGCGGCGGCCATCGCCAGCATGTCCCGCCCGCGGCGCGGCAACGTGTACTGGGTGCGCGACGCCGCCACCGGTGTGCGC
GTGCCCGTGCGCACCCGCCCCCCTCGCACTTGAAGATGCTGACTTCGCGATGTTGATGTGTCCCAGCGGCGAGGAGGATGTCC
AAGCGCAAATACAAGGAAGAGATGCTCCAGGTCATCGCGCCTGAGATCTACGGCCCCGCGGTGAAGGAGGAAAGAAAGCCC
CGCAAACTGAAGCGGGTCAAAAAGGACAAAAAGGAGGAGGAAGATGTGGACGGACTGGTGGAGTTTGTGCGCGAGTTCGC
CCCCCGGCGGCGCGTGCAGTGGCGCGGGCGGAAAGTGAAACCGGTGCTGCGGCCCGGCACCACGGTGGTCTTCACGCCCGG
CGAGCGTTCCGGCTCCGCCTCCAAGCGCTCCTACGACGAGGTGTACGGGGACGAGGACATCCTCGAGCAGGCGGTCGAGCGT
CTGGGCGAGTTTGCTTACGGCAAGCGCAGCCGCCCCGCGCCCTTGAAAGAGGAGGCGGTGTCCATCCCGCTGGACCACGGCA
ACCCCACGCCGAGCCTGAAGCCGGTGACCCTGCAGCAGGTGCTGCCGAGCGCGGCGCCGCGCCGGGGCTTCAAGCGCGAGG
GCGGCGAGGATCTGTACCCGACCATGCAGCTGATGGTGCCCAAGCGCCAGAAGCTGGAGGACGTGCTGGAGCACATGAAGG
TGGACCCCGAGGTGCAGCCCGAGGTCAAGGTGCGGCCCATCAAGCAGGTGGCCCCGGGCCTGGGCGTGCAGACCGTGGACA
TCAAGATCCCCACGGAGCCCATGGAAACGCAGACCGAGCCCGTGAAGCCCAGCACCAGCACCATGGAGGTGCAGACGGATCC
CTGGATGCCGGCGCCGGCTTCCACCACTCGCCGAAGACGCAAGTACGGCGCGGCCAGCCTGCTGATGCCCAACTACGCGCTG
CATCCTTCCATCATCCCCACGCCGGGCTACCGCGGCACGCGCTTCTACCGCGGCTACACCAGCAGCCGCCGCAAGACCACCACC
CGCCGCCGCCGTCGTCGCACCCGCCGCAGCAGCACCGCGACTTCCGCCGCCGCCCTGGTGCGGAGAGTGTACCGCAGCGGGC
GCGAGCCTCTGACCCTGCCGCGCGCGCGCTACCACCCGAGCATCGCCATTTAACTCTGCCGTCGCCTCCTACTTGCAGATATGG
CCCTCACATGCCGCCTCCGCGTCCCCATTACGGGCTACCGAGGAAGAAAGCCGCGCCGTAGAAGGCTGACGGGGAACGGGCT
GCGTCGCCATCACCACCGGCGGCGGCGCGCCATCAGCAAGCGGTTGGGGGGAGGCTTCCTGCCCGCGCTGATCCCCATCATC
GCCGCGGCGATCGGGGCGATCCCCGGCATAGCTTCCGTGGCGGTGCAGGCCTCTCAGCGCCACTGAGACACAGCTTGGAAAA
TTTGTAATAAAAAAATGGACTGACGCTCCTGGTCCTGTGATGTGTGTTTTTAGATGGAAGACATCAATTTTTCGTCCCTGGCAC
CGCGACACGGCACGCGGCCGTTTATGGGCACCTGGAGCGACATCGGCAACAGCCAACTGAACGGGGGCGCCTTCAATTGGAG
CAGTCTCTGGAGCGGGCTTAAGAATTTCGGGTCCACGCTCAAAACCTATGGCAACAAGGCGTGGAACAGCAGCACAGGGCAG
GCGCTGAGGGAAAAGCTGAAAGAGCAGAACTTCCAGCAGAAGGTGGTCGATGGCCTGGCCTCGGGCATCAACGGGGTGGTG
GACCTGGCCAACCAGGCCGTGCAGAAACAGATCAACAGCCGCCTGGACGCGGTCCCGCCCGCGGGGTCCGTGGAGATGCCCC
AGGTGGAGGAGGAGCTGCCTCCCCTGGACAAGCGCGGCGACAAGCGACCGCGTCCCGACGCGGAGGAGACGCTGCTGACGC
ACACGGACGAGCCGCCCCCGTACGAGGAGGCGGTGAAACTGGGTCTGCCCACCACGCGGCCCGTGGCGCCTCTGGCCACCGG
GGTGCTGAAACCCAGCAGCAGCAGCCAGCCCGCGACCCTGGACTTGCCTCCGCCTGCTTCCCGCCCCTCCACAGTGGCTAAGC
CCCTGCCGCCGGTGGCCGTCGCGTCGCGCGCCCCCGAGGCCGCCCCCAGGCGAACTGGCAGAGCACTCTGAACAGCATCGT
GGGTCTGGGAGTGCAGAGTGTGAAGCGCCGCCGCTGCTATTAAAAGACACTGTAGCGCTTAACTTGCTTGTCTGTGTGTATAT
GTATGTCCGCCGACCAGAAGGAGGAAGAGGCGCGTCGCCGAGTTGCAAGATGGCCACCCCATCGATGCTGCCCCAGTGGGC
GTACATGCACATCGCCGGACAGGACGCTTCGGAGTACCTGAGTCCGGGTCTGGTGCAGTTCGCCCGCGCCACAGACACCTACT
TCAGTCTGGGGAACAAGTTTAGGAACCCCACGGTGGCGCCCACGCACGATGTGACCACCGACCGCAGCCAGCGGCTGACGCT
GCGCTTCGTGCCCGTGGACCGCGAGGACAACACCTACTCGTACAAAGTGCGCTACACGCTGGCCGTGGGCGACAACCGCGTG
CTGGACATGGCCAGCACCTACTTTGACATCCGCGGCGTGCTGGATCGGGGCCCAGCTTCAAACCCTACTCCGGCACCGCCTA
CAACAGCCTGGCTCCCAAGGGAGCGCCCAACACTTGCCAGTGGACATATAAAGCTGGTGATACTGATACAGAAAAACCTATA
CATATGGAAATGCACCTGTGCAAGGCATTAGCATTACAAAGGATGGTATTCAACTTGGAACTGACAGCGATGGTCAGGCAATC
TATGCAGACGAAACTTATCAACCAGAGCCTCAAGTGGGTGATGCTGAATGGCATGACATCACTGGTACTGATGAAAAATATGG
AGGCAGAGCTCTTAAGCCTGACACCAAAATGAAGCCTTGCTATGGTTCTTTTGCCAAGCCTACCAATAAAGAAGGAGGCCAGG
CAAATGTGAAAACCGAAACAGGCGGTACCAAAGAATATGACATTGACATGGCATTCTTCGATAATCGAAGTGCAGCTGCCGCC
GGCCTAGCCCCAGAAATTGTTTTGTATACTGAGAATGTGGATCTGGAAACTCCAGATACCCATATTGTATACAAGGCAGGTAC
AGATGACAGTAGCTCTTCTATCAATTTGGGTCAGCAGTCCATGCCCAACAGACCCAACTACATTGGCTTCAGAGACAACTTTAT
CGGTCTGATGTACTACAACAGCACTGGCAATATGGGTGTACTGGCTGGACAGGCCTCCCAGCTGAATGCTGTGGTGGACTTGC
AGGACAGAAACACCGAACTGTCCTACCAGCTCTTGCTTGACTCTCTGGGTGACAGAACCAGGTATTTCAGTATGTGGAATCAG
GCGGTGGACAGTTATGACCCCGATGTGCGCATTATTGAAAATCACGGTGTGGAGGATGAACTTCCTAACTATTGCTTCCCCCTG
GATGCTGTGGGTAGAACTGATACTTACCAGGGAATTAAGGCCAATGGTGATAATCAAACCACCTGGACCAAAGATGATACTGT
TAATGATGCTAATGAATTGGGCAAGGGCAATCCTTTCGCCATGGAGATCAACATCCAGGCCAACCTGTGGCGGAACTTCCTCT
ACGCGAACGTGGCGCTGTACCTGCCCGACTCCTACAAGTACACGCCGGCCAACATCACGCTGCCCACCAACACCAACACCTAC
GATTACATGAACGGCCGCGTGGTGGCGCCCTCGCTGGTGGACGCCTACATCAACATCGGGGCGCGCTGGTCGCTGGACCCCA
TGGACAACGTCAACCCCTTCAACCACCACCGCAACGCGGGCCTGCGATACCGCTCCATGCTCCTGGGCAACGGGCGCTACGTG
CCCTTCCACATCCAGGTGCCCCAAAAGTTTTTCGCCATCAAGAGCCTCCTGCTCCTGCCCGGGTCCTACACCTACGAGTGGAACT
TCCGCAAGGACGTCAACATGATCCTGCAGAGCTCCCTCGGCAACGACCTGCGCACGGACGGGGCCTCCATCGCCTTCACCAGC
ATCAACCTCTACGCCACCTTCTTCCCCATGGCGCACAACACCGCCTCCACGCTCGAGGCCATGCTGCGCAACGACACCAACGAC
```

Fig. 22F

```
CAGTCCTTCAACGACTACCTCTCGGCGGCCAACATGCTCTACCCCATCCCGGCCAACGCCACCAACGTGCCCATCTCCATCCCCT
CGCGCAACTGGGCCGCCTTCCGCGGCTGGTCCTTCACGCGCCTCAAGACCCGCGAGACGCCCTCGCTCGGCTCCGGGTTCGAC
CCCTACTTCGTCTACTCGGGCTCCATCCCCTACCTCGACGGCACCTTCTACCTCAACCACACCTTCAAGAAGGTCTCCATCACCTT
CGACTCCTCCGTCAGCTGGCCCGGCAACGACCGCCTCCTGACGCCCAACGAGTTCGAAATCAAGCGCACCGTCGACGGAGAG
GGGTACAACGTGGCCCAGTGCAACATGACCAAGGACTGGTTCCTGGTCCAGATGCTGGCCCACTACAACATCGGCTACCAGG
GCTTCTACGTGCCCGAGGGCTACAAGGACCGCATGTACTCCTTCTTCCGCAACTTCCAGCCCATGAGCCGCCAGGTCGTGGAC
GAGGTCAACTACAAGGACTACCAGGCCGTCACCCTGGCCTACCAGCACAACAACTCGGGCTTCGTCGGCTACCTCGCGCCCAC
CATGCGCCAGGGCCAGCCCTACCCCGCCAACTACCCCTACCCGCTCATCGGCAAGAGCGCCGTCGCCAGCGTCACCCAGAAAA
AGTTCCTCTGCGACCGGGTCATGTGGCGCATCCCCTTCTCCAGCAACTTCATGTCCATGGGCGCGCTCACCGACCTCGGCCAGA
ACATGCTCTACGCCAACTCCGCCCACGCGCTAGACATGAATTTCGAAGTCGACCCCATGGATGAGTCCACCCTTCTCTATGTTGT
CTTCGAAGTCTTCGACGTCGTCCGAGTGCACCAGCCCCACCGCGGCGTCATCGAGGCCGTCTACCTGCGCACGCCCTTCTCGGC
CGGCAACGCCACCACCTAAGCCTCTTGCTTCTTGCAAGATGACGGCCTGCGCGGGCTCCGGCGAGCAGGAGCTCAGGGCCATC
CTCCGCGACCTGGGCTGCGGGCCCTGCTTCCTGGGCACCTTCGACAAGCGCTTCCCGGGATTCATGGCCCCGCACAAGCTGGC
CTGCGCCATCGTCAACACGGCCGGCCGCGAGACCGGGGGCGAGCACTGGCTGGCCTTCGCCTGGAACCCGCGCTCCCACACC
TGCTACCTCTTCGACCCCTTCGGGTTCTCGGACGAGCGCCTCAAGCAGATCTACCAGTTCGAGTACGAGGGCCTGCTGCGTCGC
AGCGCCCTGGCCACCGAGGACCGCTGCGTCACCCTGGAAAAGTCCACCCAGACCGTGCAGGGTCCGCGCTCGGCCGCCTGCG
GGCTCTTCTGCTGCATGTTCCTGCACGCCTTCGTGCACTGGCCCGACCGCCCCATGGACAAGAACCCCACCATGAACTTGCTGA
CGGGGGTGCCCAACGGCATGCTCCAGTCGCCCCAGGTGGAACCCACCCTGCGCCGCAACCAGGAGGCGCTCTACCGCTTCCTC
AACGCCCACTCCGCCTACTTTCGCTCCCACCGCGCGCGCATCGAGAAGGCCACCGCCTTCGACCGCATGAATCAAGACATGTAA
TCCGGTGTGTGTATGTGAATGCTTTATTCATCATAATAAACAGCACATGTTTATGCCACCTTCTCTGAGGCTCTGACTTTATTTA
GAAATCGAAGGGGTTCTGCCGGCTCTCGGCATGGCCCGCGGGCAGGGATACGTTGCGGAACTGGTACTTGGGCAGCCACTTG
AACTCGGGGATCAGCAGCTTCGGCACGGGGAGGTCGGGGAACGAGTCGCTCCACAGCTTGCGCGTGAGTTGCAGGGCGCCC
AGCAGGTCGGGCGCGGAGATCTTGAAATCGCAGTTGGGACCCGCGTTCTGCGCGCGAGAGTTACGGTACACGGGGTTGCAG
CACTGGAACACCATCAGGGCCGGGTGCTTCACGCTCGCCAGCACCGTCGCGTCGGTGATGCCCTCCACGTCCAGATCCTCGGC
GTTGGCCATCCCGAAGGGGGTCATCTTGCAGGTCTGCCGCCCATGCTGGGCACGCAGCCGGGCTTGTGGTTGCAATCGCAGT
GCAGGGGATCAGCATCATCTGGGCCTGCTCGGAGCTCATGCCCGGGTACATGGCCTTCATGAAAGCCTCCAGCTGGCGGAA
GGCCTGCTGCGCCTTGCCGCCCTCGGTGAAGAAGACCCGCAGGACTTGCTAGAGAACTGGTTGGTGGCGCAGCCAGCGTCG
TGCACGCAGCAGCGCGCGTCGTTGTTGGCCAGCTGCACCACGCTGCGCCCCAGCGGTTCTGGGTGATCTTGGCCCGGTCGG
GGTTCTCCTTCAGCGCGCGCTGCCCGTTCTCGCTCGCCACATCCATCTCGATCGTGTGCTCCTTCTGGATCATCACGGTCCCGTG
CAGGCACCGCAGCTTGCCCTCGGCCTCGGTGCACCCGTGCAGCCACAGCGCGCAGCCGGTGCTCTCCCAGTTCTTGTGGGCGA
TCTGGGAGTGCGAGTGCACGAAGCCCTGCAGGAAGCGGCCCATCATCGTGGTCAGGGTCTTGTTGCTGGTGAAGGTCAGCGG
AATGCCGCGGTGCTCCTCGTTCACATACAGGTGGCAGATACGGCGGTACACCTCGCCCTGCTCGGGCATCAGCTGGAAGGCG
GACTTCAGGTCGCTCTCCACGCGGTACCGGTCCATCAGCAGCGTCATCACTTCCATGCCCTTCTCCCAGGCCGAAACGATCGGC
AGGCTCAGGGGGTTCTTCACCGTTGTCATCTTAGTCGCCGCCGCCAAGTCAGGGGGTCGTTCTCGTCCAGGGTCTCAAACAC
TCGCTTGCCGTCCTTCTCGGTGATGCGCACGGGGGGAAAGCTGAAGCCCACGGCCGCCAGCTCCTCCTCGGCCTGCCTTTCGT
CCTCGCTGTCCTGGCTGATGTCTTGCAAAGGCACATGCTTGGTCTTGCGGGGTTTCTTTTTGGGCGGCAGAGGCGGCGGCGGA
GACGTGCTGGGCGAGCGCGAGTTCTCGCTCACCACGACTATTTCTTCTCCTTGGCCGTCGTCCGAGACCACGCGGCGGTAGGC
ATGCCTCTTCTGGGGCAGAGGCGGAGGCGACGGGCTCTCGCGGTTCGGCGGGCGGCTGGCAGAGCCCCTTCCGCGTTCGGG
GGTGCGCTCCTGGCGGCGCTGCTCTGACTGACTTCCTCCGCGGCCGGCCATTGTGTTCTCCTAGGGAGCAAGCATGGAGACTC
AGCCATCGTCGCCAACATCGCCATCTGCCCCCGCCGCCGCCGACGAGAACCAGCAGCAGCAGAATGAAAGCTTAACCGCCCCG
CCGCCCAGCCCCACCTCCGACGCCGCAGCCCCAGACATGCAAGAGATGGAGGAATCCATCGAGATTGACCTGGGCTACGTGA
CGCCCGCGGAGCACGAGGAGGAGCTGGCAGCGCGCTTTTCAGCCCCGGAAGAGAACCACCAAGAGCAGCCAGAGCAGGAAG
CAGAGAGCGAGCAGAACCAGGCTGGGCTCGAGCATGGCGACTACCTGAGCGGGGCAGAGGACGTGCTCATCAAGCATCTGG
CCCGCCAATGCATCATCGTCAAGGACGCGCTGCTCGACCGCGCCGAGGTGCCCCTCAGCGTGGCGGAGCTCAGCCGCGCCTAC
GAGCGCAACCTCTTCTCGCCGCGCGTGCCCCCCAAGCGCCAGCCCAACGGCACCTGCGAGCCCAACCCGCCCTCAACTTCTAC
CCGGTCTTCGCGGTGCCCGAGGCCCTGGCCACCTACCACCTCTTTTTCAAGAACCAAAGGATCCCCGTCTCCTGCCGCGCCAAC
CGCACCCGCGCCGACGCCCTGCTCAACCTGGGCCCCGGCGCCCGCCTACCTGATATCGCCTCCTTGGAAGAGGTTCCCAAGAT
CTTCGAGGGTCTGGGCAGCGACGAGACTCGGGCCGCGAACGCTCTGCAAGGAAGCGGAGAGGAGCATGAGCACCACAGCGC
CCTGGTGGAGTTGGAAGGCGACAACGCGCGCCTGGCGGTCCTCAAGCGCACGGTCGAGCTGACCCACTTCGCCTACCCGGCG
CTCAACCTGCCCCCCAAGGTCATGAGCGCCGTCATGGACCAGGTGCTCATCAAGCGCGCCTCGCCCCTCTCGGAGGAGGAGAT
GCAGGACCCCGAGAGCTCGGACGAGGGCAAGCCCGTGGTCAGCGACGAGCAGCTGGCGCGCTGGCTGGGAGCGAGTAGCA
```

Fig. 22G

CCCCCCAGAGCCTGGAAGAGCGGCGCAAGCTCATGATGGCCGTGGTCCTGGTGACCGTGGAGCTGGAGTGTCTGCGCCGCTT
CTTCGCCGACGCGGAGACCCTGCGCAAGGTCGAGGAGAACCTGCACTACCTCTTCAGACACGGGTTCGTGCGCCAGGCCTGC
AAGATCTCCAACGTGGAGCTGACCAACCTGGTCTCCTACATGGGCATCCTGCACGAGAACCGCCTGGGGCAGAACGTGCTGCA
CACCACCCTGCGCGGGGAGGCCCGCCGCGACTACATCCGCGACTGCGTCTACCTGTACCTCTGCCACACCTGGCAGACGGGCA
TGGGCGTGTGGCAGCAGTGCCTGGAGGAGCAGAACCTGAAAGAGCTCTGCAAGCTCCTGCAGAAGAACCTCAAGGCCCTGTG
GACCGGGTTCGACGAGCGCACCACCGCCGCGGACCTGGCCGACCTCATCTTCCCCGAGCGCCTGCGGCTGACGCTGCGCAAC
GGGCTGCCCGACTTTATGAGCCAAAGCATGTTGCAAAACTTTCGCTCTTTCATCCTCGAACGCTCCGGGATCCTGCCCGCCACC
TGCTCCGCGCTGCCCTCGGACTTCGTGCCGCTGACCTTCGCGAGTGCCCCCCGCCGCTCTGGAGCCACTGCTACCTGCTGCGC
CTGGCCAACTACCTGGCCTACCACTCGGACGTGATCGAGGACGTCAGCGGCGAGGGCCTGCTCGAGTGCCACTGCCGCTGCA
ACCTCTGCACGCCGCACCGCTCCCTGGCCTGCAACCCCAGCTGCTGAGCGAGACCCAGATCATCGGCACCTTCGAGTTGCAA
GGCCCCGGCGAGGGCAAGGGGGGTCTGAAACTCACCCCGGGGCTGTGGACCTCGGCCTACTTGCGCAAGTTCGTGCCCGAG
GACTACCATCCCTTCGAGATCAGGTTCTACGAGGACCAATCCCAGCCGCCCAAGGCCGAGCTGTCGGCCTGCGTCATCACCCA
GGGGGCCATCCTGGCCCAATTGCAAGCCATCCAGAAATCCGCCAAGAATTTCTGCTGAAAAAGGGCCACGGGGTCTACTTGG
ACCCCCAGACCGGAGAGGAGCTCAACCCCAGCTTCCCCCAGGATGCCCCGAGGAAGCAGCAAGAAGCTGAAAGTGGAGCTGC
CGCCGCCGCCGGAGGATTTGGAGGAAGACTGGGAGAGCAGTCAGGCAGAGGAGGAGGAGATGGAAGACTGGGACAGCACT
CAGGCAGAGGAGGACAGCCTGCAAGACAGTCTGGAGGAGGAAGACGAGGTGGAGGAGGCAGAGGAAGAAGCAGCCGCCG
CCAGACCGTCGTCCTCGGCGGAGGAGGAGAAAGCAAGCAGCACGGATACCATCTCCGCTCCGGGTCGGGGTCGCGGCGGCC
GGGCCCACAGTAGATGGGACGAGACCGGGCGCTTCCCGAACCCCACCACCCAGACCGGTAAGAAGGAGCGGCAGGGATACA
AGTCCTGGCGGGGGCACAAAAACGCCATCGTCTCCTGCTTGCAAGCCTGCGGGGGCAACATCTCCTTCACCCGGCGCTACCTG
CTCTTCCACCGCGGGGTGAACTTCCCCCGCAACATCTTGCATTACTACCGTCACCTCCACAGCCCCTACTACTGTTTCCAAGAAG
AGGCAGAAACCCAGCAGCAGCAGCAGCAGCAGAAACCAGCGGCAGCAGCTAGAAAATCCACAGCGGCGGCAGGTGGACT
GAGGATCGCGGCGAACGAGCCGGCGCAGACCCGGGAGCTGAGGAACCGGATCTTTCCCACCCTCTATGCCATCTTCCAGCAG
AGTCGGGGGCAAGAGCAGGAACTGAAAGTCAAGAACCGTTCTCTGCGCTCGCTCACCCGCAGTTGTCTGTATCACAAGAGCG
AAGACCAACTTCAGCGCACTCTCGAGGACGCCGAGGCTCTCTTCAACAAGTACTGCGCGCTCACTCTTAAAGAGTAGCCCGCG
CCCGCCCACACACGGAAAAAGGCGGGAATTACGTCACCACCTGCGCCCTTCGCCCGACCATCATCATGAGCAAAGAGATTCCC
ACGCCTTACATGTGGAGCTACCAGCCCCAGATGGGCCTGGCCGCCGGCGCCGCCCAGGACTACTCCACCCGCATGAACTGGCT
CAGTGCCGGGCCCGCGATGATCTCACGGGTGAATGACATCCGCGCCCACCGAAACCAGATACTCCTAGAACAGTCAGCGATCA
CCGCCACGCCCCGCCATCACCTTAATCCGCGTAATTGGCCCGCCGCCCTGGTGTACCAGGAAATTCCCCAGCCCACGACCGTAC
TACTTCCGCGAGACGCCCAGGCCGAAGTCCAGCTGACTAACTCAGGTGTCCAGCTGGCCGGCGGCGCCGCCCTGTGTCGTCAC
CGCCCCGCTCAGGGTATAAAGCGGCTGGTGATCCGAGGCAGAGGCACACAGCTCAACGACGAGGTGGTGAGCTCTTCGCTGG
GTCTGCGACCTGACGGAGTCTTCCAACTCGCCGGATCGGGGAGATCTTCCTTCACGCCTCGTCAGGCCGTCCTGACTTTGGAG
AGTTCGTCCTCGCAGCCCCGCTCGGGTGGCATCGGCACTCTCCAGTTCGTGGAGGAGTTCACTCCCTCGGTCTACTTCAACCCC
TTCTCCGGCTCCCCCGGCCACTACCCGGACGAGTTCATCCCGAACTTCGACGCCATCAGCGAGTCGGTGGACGGCTACGATTG
AATGTCCCATGGTGGCGCGGCTGACCTAGCTCGGCTTCGACACCTGGACCACTGCCGCCGCTTCCGCTGCTTCGCTCGGGATCT
CGCCGAGTTTGCCTACTTTGAGCTGCCCGAGGAGCACCCTCAGGGCCCGGCCCACGAGTGCGGATCGTCGTCGAAGGGGGT
CTCGACTCCCACCTGCTTCGGATCTTCAGCCAGCGTCCGATCCTGGCCGAGCGCGAGCAAGGACAGACCCTTCTGACCCTGTAC
TGCATCTGCAACCACCCCGGCCTGCATGAAAGTCTTTGTTGTCTGCTGTGTACTGAGTATAATAAAAGCTGAGATCAGCGACTA
CTCCGGACTTCCGTGTGTTCCTGCTATCAACCAGTCCCTGTTCTTCACCGGGAACGAGACCGAGCTCCAGCTCCAGTGTAAGCC
CCACAAGAAGTACCTCACCTGGCTGTTCCAGGGCTCTCCGATCGCCGTTGTCAACCACTGCGACAACGACGGAGTCCTGCTGA
GCGGCCCTGCCAACCTTACTTTTTCCACCCGCAGAAGCAAGCTCCAGCTCTTCCAACCCTTCCTCCCCGGGACCTATCAGTGCGT
CTCGGGACCCTGCCATCACACCTTCCACCTGATCCCGAATACCACAGCGTCGCTCCCGCTACTAACAACCAAACTACCCACCAA
CGCCACCGTCGCGACCGCGGACATGTACAGAGCTCGAGAAGTACTAGGCCACAATACATGCCCATATTAGACTATGAGGCCGA
GCCACAGCGACCCATGCTCCCGCTATTAGTTACTTCAATCTAACCGGCGGAGATGACTGACCCACTGGCCAACAACAACGTCA
ACGACCTTCTCCTGGACATGGACGGCCGCGCCTCGGAGCAGCGACTCGCCCAACTTCGCATTCGCCAGCAGCAGGAGAGAGC
CGTCAAGGAGCTGCAGGACGGCATAGCCATCCACCAGTGCAAGAAAGGCATCTTCTGCCTGGTGAAACAGGCCAAGATCTCC
TACGAGGTCACCCCGACCGACCATCGCCTCTCCTACGAGCTCCTGCAGCAGCGCCAGAAGTTCACCTGCCTGGTCGGAGTCAA
CCCCATCGTCATCACCCAGCAGTCGGGCGATACCAAGGGGTGCATCCACTGCTCCTGCGACTCCCCGACTGCGTCCACACTCT
GATCAAGACCCTCTGCGGCCTCCGCGACCTCCTCCCCATGAACTAATCACCCCCTTATCCAGTGAAATAAATATCATATTGATGA
TGATTTAAATAAAAAATAATCATTTGATTTGAAATAAAGATACAATCATATTGATGATTTGAGTTTTAAAAAATAAAGAATCACT
TACTTGAAATCTGATACCAGGTCTCTGTCCATGTTTTCTGCCAACACCACCTCACTCCCCTCTTCCCAGCTCTGGTACTGCAGACC
CCGGCGGGCTGCAAACTTCCTCCACACGCTGAAGGGGATGTCAAATTCCTCCTGTCCCTCAATCTTCATTTTATCTTCTATCAGA

Fig. 22H

```
TGTCCAAAAAGCGCGTCCGGGTGGATGATGACTTCGACCCCGTCTACCCCTACGATGCAGACAACGCACCGACCGTGCCCTTC
ATCAACCCCCCCTTCGTCTCTTCAGATGGATTCCAAGAGAAGCCCCTGGGGGTGCTGTCCCTGCGACTGGCTGACCCCGTCACC
ACCAAGAACGGGGAAATCACCCTCAAGCTGGGAGAGGGGGTGGACCTCGACTCCTCGGGAAAACTCATCTCCAACACGGCCA
CCAAGGCCGCCGCCCCTCTCAGTTTTTCCAACAACACCATTTCCCTTAACATGGATACCCCTCTTTATACCAAAGATGGAAAATT
ATCCTTACAAGTTTCTCCACCGTTAAACATATTAAAATCAACCATTCTGAACACATTAGCTGTAGCTTATGGATCAGGTTTAGGA
CTGAGTGGTGGCACTGCTCTTGCAGTACAGTTGGCCTCTCCACTCACTTTTGATGAAAAAGGAAATATTAAAATTAACCTAGCC
AGTGGTCCATTAACAGTTGATGCAAGTCGACTTAGTATCAACTGCAAAGAGGGGTCACTGTCACTACCTCAGGAGATGCAAT
TGAAAGCAACATAAGCTGGCCTAAAGGTATAAGATTTGAAGGTAATGGCATAGCTGCAAACATTGGCAGAGGATTGGAATTT
GGAACCACTAGTACAGAGACTGATGTCACAGATGCATACCCAATTCAAGTTAAATTGGGTACTGGCCTTACCTTTGACAGTACA
GGCGCCATTGTTGCTTGGAACAAAGAGGATGATAAACTTACATTATGGACCACAGCCGACCCCTCGCCAAATTGCAAAATATA
CTCTGAAAAAGATGCCAAACTCACACTTTGCTTGACAAAGTGTGGAAGTCAAATTCTGGGTACTGTGACTGTATTGGCAGTGA
ATAATGGAAGTCTCAACCCAATCACAAACACAGTAAGCACTGCACTCGTCTCCCTCAAGTTTGATGCAAGTGGAGTTTTGCTAA
GCAGCTCCACATTAGACAAAGAATATTGGAACTTCAGAAAGGGAGATGTTACACCTGCTGAGCCCTATACTAATGCTATAGGT
TTTATGCCTAACATAAAGGCCTATCCTAAAAACACATCTGCAGCTTCAAAAAGCCATATTGTCAGTCAAGTTTATCTCAATGGG
GATGAGGCCAAACCACTGATGCTGATTATTACTTTTAATGAAACTGAGGATGCAACTTGCACCTACAGTATCACTTTTCAATGG
AAATGGGATAGTACTAAGTACACAGGTGAAACACTTGCTACCAGCTCCTTCACCTTCTCCTACATCGCCCAAGAATGAACACTG
TATCCCACCCTGCATGCCAACCCTTCCCACCCCACTCTGTCTATGGAAAAAACTCTGAAGCACAAAATAAAATAAAGTTCAAGT
GTTTTATTGATTCAACAGTTTTACAGGATTCGAGCAGTTATTTTTCCTCCACCCTCCCAGGACATGGAATACACCACCCTCTCCCC
CCGCACAGCCTTGAACATCTGAATGCCATTGGTGATGGACATGCTTTTGGTCTCCACGTTCCACACAGTTTCAGAGCGAGCCAG
TCTCGGGTCGGTCAGGGAGATGAAACCCTCCGGGCACTCCCGCATCTGCACCTCACAGCTCAACAGCTGAGGATTGTCCTCGG
TGGTCGGGATCACGGTTATCTGGAAGAAGCAGAAGAGCGGCGGTGGGAATCATAGTCCGCGAACGGGATCGGCCGGTGGTG
TCGCATCAGGCCCCGCAGCAGTCGCTGCCGCCGCCGCTCCGTCAAGCTGCTGCTCAGGGGGTCCGGGTCCAGGGACTCCCTCA
GCATGATGCCCACGGCCCTCAGCATCAGTCGTCTGGTGCGGCGGGCGCAGCAGCGCATGCGGATCTCGCTCAGGTCGCTGCA
GTACGTGCAACACAGGACCACCAGGTTGTTCAACAGTCCATAGTTCAACACGCTCCAGCCGAAACTCATCGCGGGAAGGATGC
TACCCACGTGGCCGTCGTACCAGATCCTCAGGTAAATCAAGTGGCGCTCCCTCCAGAACACGCTGCCCACGTACATGATCTCCT
TGGGCATGTGGCGGTTCACCACCTCCCGGTACCACATCACCCTCTGGTTGAACATGCAGCCCCGGATGATCCTGCGGAACCAC
AGGGCCAGCACCGCCCCGCCCGCCATGCAGCGAAGAGACCCCGGGTCCCGGCAATGGCAATGGAGGACCCACCGCTCGTACC
CGTGGATCATCTGGGAGCTGAACAAGTCTATGTTGGCACAGCACAGGCATATGCTCATGCATCTCTTCAGCACTCTCAGCTCCT
CGGGGGTCAAAACCATATCCCAGGGCACGGGGAACTCTTGCAGGACAGCGAACCCCGCAGAACAGGGCAATCCTCGCACATA
ACTTACATTGTGCATGGACAGGGTATCGCAATCAGGCAGCACCGGGTGATCCTCCACCAGAGAAGCGCGGGTCTCGGTCTCCT
CACAGCGTGGTAAGGGGGCCGGCCGATACGGGTGATGGCGGGACGCGGCTGATCGTGTTCGCGACCGTGTCATGATGCAGT
TGCTTTCGGACATTTTCGTACTTGCTGTAGCAGAACCTGGTCCGGGCGCTGCACACCGATCGCCGGCGGCGGTCCCGGCGCTT
GGAACGCTCGGTGTTGAAATTGTAAAACAGCCACTCTCTCAGACCGTGCAGCAGATCTAGGGCCTCAGGAGTGATGAAGATCC
CATCATGCCTGATAGCTCTGATCACATCGACCACCGTGGAATGGGCCAGACCCAGCCAGATGATGCAATTTTGTTGGGTTTCG
GTGACGGCGGGGAGGGAAGAACAGGAAGAACCATGATTAACTTTTAATCCAAACGGTCTCGGAGCACTTCAAAATGAAGGT
CGCGGAGATGGCACCTCTCGCCCCGCTGTGTTGGTGGAAAATAACAGCCAGGTCAAAGGTGATACGGTTCTCGAGATGTTCC
ACGGTGGCTTCCAGCAAAGCCTCCACGCGCACATCCAGAAACAAGACAATAGCGAAAGCGGGAGGGTTCTCTAATTCCTCAAT
CATCATGTTACACTCCTGCACCATCCCCAGATAATTTTCATTTTTCCAGCCTTGAATGATTCGAACTAGTTCCTGAGGTAAATCCA
AGCCAGCCATGATAAAGAGCTCGCGCAGAGCGCCCTCCACCGGCATTCTTAAGCACACCCTCATAATTCCAAGATATTCTGCTC
CTGGTTCACCTGCAGCAGATTGACAAGCGGAATATCAAAATCTCTGCCGCGATCCCTAAGCTCCTCCCTCAGCAATAACTGTAA
GTACTCTTTCATATCCTCTCCGAAATTTTTAGCCATAGGACCACCAGGAATAAGATTAGGGCAAGCCACAGTACAGATAAACCG
AAGTCCTCCCCAGTGAGCATTGCCAAATGCAAGACTGCTATAAGCATGCTGGCTAGACCCGGTGATATCTTCCAGATAACTGG
ACAGAAAATCACCCAGGCAATTTTTAAGAAAATCAACAAAAGAAAAATCCTCCAGGTGCACGTTTAGAGCCTCGGGAACAACG
ATGAAGTAAATGCAAGCGGTGCGTTCCAGCATGGTTAGTTAGCTGATCTGTAAAAAACAAAAAATAAAACATTAAACCATGCT
AGCCTGGCGAACAGGTGGGTAAATCGTTCTCTCCAGCACCAGGCAGGCCACGGGGTCTCCGGCGCGACCCTCGTAAAAATTG
TCGCTATGATTGAAAACCATCACAGAGACGTTCCCGGTGGCCGGCGTGAATGATTCGACAAGATGAATACACCCCCGGAAC
ATTGGCGTCCGCGAGTGAAAAAAGCGCCCGAGGAAGCAATAAGGCACTACAATGCTCAGTCTCAAGTCCAGCAAAGCGATG
CCATGCGGATGAAGCACAAAATCCTCAGGTGCGTACAAAATGTAATTACTCCCTCCTGCACAGGCAGCGAAGCCCCCGATCC
CTCCAGATACACATACAAAGCCTCAGCGTCCATAGCTTACCGAGCAGCAGCACACAACAGGCGCAAGAGTCAGAGAAAGGCT
GAGCTCTAACCTGTCCACCCGCTCTCTGCTCAATATATAGCCCAGATCTACACTGACGTAAAGGCCAAAGTCTAAAAATACCCG
CCAAATAATCACACACGCCCAGCACACGCCCAGAAACCGGTGACACACTCAAAAAAATACGCGCACTTCCTCAAACGCCCAAA
CTGCCGTCATTTCCGGGTTCCCACGCTACGTCATCGGAATTCGACTTTCAAATTCCGTCGACCGTTAAAAACGTCACCCGCCCCG
CCCCTAACGGTCGCCCGTCTCTCGGCCAATCACCTTCCTCCCTCCCCAAATTCAAACAGCTCATTTGCATATTAACGCGCACCAA
AAGTTTGAGGTATATTATTGATGATG
```

Fig. 22I

AdC7 010-HIVgp140(E1469) Amino acids – SEQ ID NO: 11
**The symbol " * " refers herein to stop codons in the non coding regions**

HHQ*YTSNFWCALICK*AV*IWGGRKVIGRETGDR*GRGG*RFDDVAVRRSRFASSRGKSDVKRGVV*TRKYSIFPRSLTGNEVFLG
GCK*KRAIFARKLNEEVKI*VISRLWQGGVFAEGRVDFDRLRGGFDYRIFHLNFRVRCQSPVFLRTISFPRKCHLTVTITVLR*RKLRSP
DPLWCTLSTICSDAA*LSQYLLPACVLEVAE*CASKI*ATTRQGLTDNCMKNLLRVRRFALLRDVRARYTR*H*LLTSMPSTPPIDVND
GKWPAWHYAQYMTLWDFPTWQYIYVLVIAITMVMRFWQYINGRG*RFDSRGFPSLHPIDVNGSLFWHQNQRDFPKCRNNSAP
LTQMGGRRVRWEVYISRARLVNRQITRSFIAVVYHS*IANAVSASDTTVSNLRLEYLIRLTIG*LRLEFDATMRVMGILRSYQQWWI
WGILGFWMLMICNVWGNLWVTVYYGVPVWKEAKTTLFCASDAKAHKEEVHNIWATHACVPTDPNPQEIVLKNVTENFNMWK
NDMVDQMHEDIISLWDQSLKPCVKLTPLCVTLNCSDVKIKGTNATYNNATYNNNNTISDMKNCSFNTTTEITDKKKKEYALFYKLDV
VALDGKETNSTNSSEYRLINCNTSAVTQACPKVSFDPIPIHYCAPAGYAILKCNNKTFNGTGPCNNVSTVQCTHGIKPVVSTQLLLNG
SLAEEEVVIRFENLTNNAKIIVHLNESVEINCTRPSNNTRKSVRIGPGQTFFATGDIIGDIRQAHCNISRKKWNTTLQRVKEKLKEKFPN
KTIQFAPSSGGDLEITTHSFNCRGEFFYCYTSDLFNSTYMSNNTGGANITLQCRIKQIIRMWQGVGQAMYAPPIAGNITCKSNITGLL
LTRDGGKEKNDTETFRPGGGDMRDNWRSELYKYKVVEIKPLGIAPDKAKLTVQARQLLSGIVQQQSNLLRAIEAQQHMLQLTVWG
IKQLQTRVLAIERYLKDQQLLGIWGCSGKLICTTAVPWNASWSNKSYEEIWGNMTWMQWDREINNYTNTIYSLLEESQNQQEKNE
KDLLALDSWESLWSWFNITNWLW*GTSRVDPGGQTADQPRLCLLVASHLLFAPPPCLP*PWKVPLPLSFPNKMRKLHRIV*VGVIL
FWGVGWGRTARGRIGKTIAGMLGMRWALWLLRRKEPADLQI*IHLCRVRRKRNGIMGIMGLHIGQISICWPPCM*PRTPA
RHGPSSSTTS*PDAMCTWGPAEACSCPTSATCNL*RCCWSPMPCPE*A*RGCLT*MWSCGKF*DMMNPRPGAGPANAEASTP
GFSPCVWR*RRTCDPIIWCCPATGRSSAPAGKNLTRVSSVWGRWRACMRGRMTKICVFLCVAAA*AEAPPLREGYSALI*RGVSPP
GRECVRM*WDPRWTAGPCSPRTLQP*PTRP*APRPWTQLPPQLLLPPPAPCAEWPWAPATTALWWPTRLPPIIPPA*TRRSCCC
*WPSSRP*PSAWAS*PSRWLSCRRRRGPRLPR*KPNKK*INK*TETVVDFNTES*IFI*FFARGRPWTTGLDH*APGGFFPGPGRGG
LGC*GTWA*ARPGGGGSSIAGPRARGWCCKSPSHSRGAGRGAARCP*GGD*WPRAAPWCRC*RTC*AGRDACGGR*DASWP
GS*DWRCSRPDPAGGSCCAGPPARCIRRTWGICHATWKGRRERIWRRPCDRPGFPCTHP**WRWARGRRPGQRRFGGRTHRSC
GPG*ARHRPF**IWGGGCPTGGRRCPRSRGRSCPRRSASPRP*ARRGGSCPPAGR*KKRFPGRGR*AGPKAGSGAAGTCRSRWG
RR*PR*PAAGGS*GRDSCRPRGGGGPPRSSSRAHACSRARVPPGGARPPARGALAARRSFSAA*XRRPWAFWRGSVARVPDGPR
AR*CALGHLDPADLLVSRVGATAGVGHQAMGVQRGQGPVLPGSQGPRQRGLRHGEGVRAGLGACEGALQAHPAGREPLPVGA
LRVGQVAIEHEFVVERLGRVALGAELTFGSVSADGTEEGLEGVELGGEEDGLGGVGVRAAAGADGLALHEPGEVGPVGVKNEVSSV
LFDAFLTSGLHELVSPLGDKEAVRVPVDRLYGPVLERGAAVLVVEEPRPLRDEGPGPGQHEGGHVGGVAVVVHQRVHLLQGMQA
HVPLVHIQEGDWLVSVGHVTGGPGRGGIKGGGPLLVLTVFRIAVQERQLLG*VFPLEGWHNLGTQVVSF*KRGGFDIDGAVGDAF
HEPLVHLVRKDDLFVVELGGEGAVEGVGEELGDGAHGLVLFLVGALLGGDVELHVLARHALPFGEDGGELVGHDSDPPAAVVQGD
EVHAGGHLAAQGLVGPAEAPALARAEGGQRVQHELVGGVGVHGEDAGQKLGVEVADAGVQIVQRRLPVAHGQRALVGAEGRA
PGHGVRERGGVHAADVVDVEGLLEDADVGGVAAPPADAGAHVVVQLVRGREEPRAEVGALRLFGAVDDLAEDGVGVGGDGGP
LEDVEVGVGQADRVPDEVGVGVLQLGDELGGDEDVQGAVVEGLLDDVVLELALLLPQLAVEKELFAVLPVLFEGEPVLIGTVRAHH
VELVDGLVGAAALLHGEGVSLCGLAQGGVGEGEGVAHHDLEELVLEVEVVAAALLPELEVRALLVGGVGQSESNIVEEDLARAGHE
VASDAERLGHLGPVVDDLGGEDDLVEAVDVVPDDVEFHESRAALNVGQLLELVVGELGGVAEPVLLEGPVGDVGVGAEEGSPEIH
GQGGLQAVPVLTELLAHGHFFGGDAVEGAGVAVPAVPLELEGEVVGELDERRVPGEFHDQHEGDELLAEGPHPGVGFHIVGEEEP
FGARMRADGEELDLLPPVGGMAVDVMEVEMPTARRALVLVLFIQASAVLATLHGMHVLHELYLGSFDEEFQWAVERWRLHLVLYY
VLAIGVAIVCLDGGHADEPAREAGPDFGSDGSESEDEGAQAGAVQGPETLRSQVSGQRRRAVDLQELFQGAREVQMVLDLHGAV
GGDVHGLQGPVPLGRHHRAPFLLGRCFHAGQKRRRGRAPGGRGGSGPGGRGGRGTSAPRAGRFWYCARRRLA*ATTRRLTSWI
*RLWVKATGPVSLNLKESSTESISVSLTAACRRISCTSPELSW*AISVMNCSISSS*RSPRPARSTVAARSLEMRPMSCEKAFMPASFQ
TRL*TTAPSGSRARMTTWARLSSTWRVKTA*LQRRW*R*LSVVAMCSVTKKYMIQRRSGISLTSPRASKRSMAS*KSTAKLKNWEL
RAETVNSSSRRRMSSAMVARTSRSKAPGGSSSSISSSSTNISSTSSSGGGGGGALRRRRRTGRRSMKRSMVSPRRRRMVSVTARP
SSRGRSVKTPPRISRWPPGGSPLGRERALTMHLINWPVGTPRKDLSVSRSTGSENR*TKASSQSQSQGRLSPVSCSSGISGGGRAML
LVMKLK*AVLRRRMVARSTRSLGPACWMRRRSAMPQAWS*HLARSL**SCMSRSTGTSSSPARPCMRVSPNPRWGWTSARSAT
TRSARMACCIWVRVVWKSSKSTKRW*APVLMV*EQLAMTDQLTVWWPGRTSSWYLRRE*ARVSKM*SLQVRTRYWYPTRKCG
GGWR*SGHRSVAGAPGARSSSMRRW*P*MYLDIQVMPAAVVEARGNSRTRFQMLRSGRK*FMVAAVWPVRRAQSWML*TY
GQKRKRSAARLRGLEAKRTGWAARVPRFESRIRLEPQLTWYWHSRLDPSLLTKPPGYGGGSFFGLGRWS*KTSKRGKRPPAMARC
RSLEKESPGLRCGVPRFEPQRSAPAGFRG*RGRGCPVVSKTP*PADFSSYGASPSFSCVFARCIPYCGRCAPTLHLNRPYRRSSSNSRR
FCPRPSSSQPLPRRPP*AEPAFSMTWPWKRARGWRGWGRRRSGTRACR*KGTLARPTCPSRTCSETGAARSPRRCAPPASTRG
GSCGAAWTESGC*GTRISRRTS*RGSAPRARTWPRPTWSRRTSRP*RRRATSKNPSTTTCAR*SRARR*PWA*CTCGTCWRPSCR
TPRASR*RRSCFWWCSTVGTTRRSGRRC*ISPSPRAAGSWTW*TFCRASWCRSAGCRCPRSWRLSTSRC*AWASTTLGRSTRPRT

Fig. 22J

```
CP*TRR*RSTGFTCA*P*KC*P*ATIWGCTATTGCTAR*APAAGAS*ATRS*CTACSGP*PGPGPRGRATLTWARTCAGSPAAGPW
KLPAVPPTWRRWTMRRRRASTWKTDGATVFLLDAATATAS*SRDAGGAAEPAVRH*LLGRLDPGHATHHGADDPQSRSL*TAAS
GQPALGHPGGRGALALEPHAREGAGHRERAGGEQGHPRRRGRAGVQRAAGARGPLQQHQRADEPGPHGDRRARGGVAARAV
PPRVEPGLHGGAERLPEHAARQRAPGPGGLHQLHQRAAADGGRGAPERGVPVGAGLLLPDQSPGLADREPEPGFQELAGTVGRA
GPGRGPRDGVEPADAELAPAAAAGGALHGQRQREPRLVPGLPA*PVPRGHRAGARGRADLPGDHPREPRAGPGGPGQPGGHP
ELPADQPVAEDPAPVRAEHRGGAHPALRAAERGAVPDAGGGHAQRRARHDRAQHGAQHVRSQPPVHQ*ADGLLASGGRHELG
LLYQRHLEPALAPAARVLHGRVRHARPQRRVPVGRRGQQRVLAAPRHHRVEERGRGPAAVLGAVRSRGCCRGGA*GRQPLPEPA
LFAEQRAQQRAGSADAAAPAGRGGVPERLLVEARAREELPQ*RDREPGGQDEPLEDVRARAQGRAPS*QQRRHP*TPATRQAAG
SGVGR*GFRRRQQRVGLGWEWWW*PVRSLAPPYRAPDVRI*KNKKRYSPRPWRPACVLLCCL**YDEARVPGGSSSLVRERDAA
GGGGGDAAPAGGALRAPAVPGAYGGAEQHSLLGAGTLVRYHPVVPGGQQVGGHRLAELPERPQQLPDHRGAEQRFHPHGGQH
PDHQL*RALAVGRPAENHHAHQHAQRERVHVQQQVQGAGDGLAQDPQWGRGG*EL*W*SGRADLRVGGV*AARGQLLGDH
DHRSDEQRHHRQLLGGGASERGAGERHRREVRHAQLPAGLGPRDRAGDAGRVHQRGLPPRHRPAARLRRGLHREPPQQPAGHP
QAAALPGGLPDPVRGPGGGQHPRALGCRSL*EKQGGGRRSGDRSRGHRLYRGAGR*FC*RRGSGRGG*NRK*DSHPAGGEGQQ
GQELQRARGQEKHRLPQLVPGLQLRRPREGRALLDAAHHLGRHLRRGASLLVAARHDARPGHLPLHASS*QLPGGGRRAPARLLQ
ELLQRAGRLLAAAARLHLAHARLQPLPREPDPRPPARAHHYHRQ*KRSCSHRSRDPAAAQQYPGSPARDRH*RQTPHLPLRLQGP
GRSRAARPLEPHLLKNVHSHLAQ**HRLGPARAQQDVRRRSPTLHATPRARARALPRSLGRPQGPRALAHHRRRRDRPGGGRRAQ
LHARRRARLHRGRRHRQRGGRCAPVRPRQEPAAAHRPAAPEHPRHARGASLAAQGQAHGTQGHAQGGQTRGLRQQQRRQDP
QTRGHGGGGHRQHVPPAARQRVLGARRRHRCARARAHPPPSHLKMLTSRC*CVPAARRMSKRKYKEEMLQVIAPEIYGPAVKE
ERKPRKLKRVKKDKKEEEDVDGLVEFVREFAPRRRVQWRGRKVKPVLRPGTTVVFTPGERSGSASKRSYDEVYGDEDILEQAVERLG
EFAYGKRSRPAPLKEEAVSIPLDHGNPTPSLKPVTLQQVLPSAAPRRGFKREGGEDLYPTMQLMVPKRQKLEDVLEHMKVDPEVQP
EVKVRPIKQVAPGLGVQTVDIKIPTEPMETQTEPVKPSTSTMEVQTDPWMPAPASTTRRRRKYGAASLLMPNYALHPSIIPTPGYRG
TRFYRGYTSSRRKTTTRRRRRRTRRSSTATSAAALVRRVYRSGREPLTLPRARYHPSIAI*LCRRLLLADMALTCRLRVPITGYRGRKPRR
RRLTGNGLRRHHHRRRRAISKRLGGGFLPALIPIIAAAIGAIPGIASVAVQASQRH*DTAWKICNKKMD*RSWSCDVCF*MEDINFSS
LAPRHGTRPFMGTWSDIGNSQLNGGAFNWSSLWSGLKNFGSTLKTYGNKAWNSSTGQALREKLKEQNFQQKVVDGLASGINGV
VDLANQAVQKQINSRLDAVPPAGSVEMPQVEEELPPLDKRGDKRPRPDAEETLLTHTDEPPPYEEAVKLGLPTTRPVAPLATGVLKP
SSSSQPATLDLPPPASRPSTVAKPLPPVAVASRAPRGRPQANWQSTLNSIVGLGVQSVKRRRCY*KTL*RLTCLSVCICMSADQKEEE
ARRRVARWPPHRCCPSGRTCTSPDRTLRST*VRVWCSSPAPQTPTSVWGTSLGTPRWRPRTM*PPTAASG*RCASCPWTARTTP
TRTKCATRWPWATTACWTWPAPTLTSAACWIGGPASNPTPAPPTTAWLPRERPTLASGHIKLVILIQKKPIHMEMHLCKALALQR
MVFNLELTAMVRQSMQTKLINQSLKWVMLNGMTSLVLMKNMEAELLSLTPK*SLAMVLLPSLPIKKEARQM*KPKQAVPKNMTL
TWHSSIIEVQLPPA*PQKLFCILRMWIWKLQIPILYTRQVQMTVALLSIWVSSPCPTDPTTLASETTLSV*CTTTALAIWVYWLDRPPS
*MLWWTCRTETPNCPTSSCLTLWVTEPGISVCGIRRWTVMTPMCALLKITVWRMNFLTIASPWMLWVELILTRELRPMVIIKPPGP
KMILLMMLMNWARAILSPWRSTSRPTCGGTSSRTWRCTCPTPTSTRRPTSRCPPTPTPTIT*TAAWWRPRWWTPTSTSGRAGR
WTPWTTSTPSTTTATRACDTAPCSWATGATCPSTSRCPKSFSPSRASCSCPGPTPTSGTSARTST*SCRAPSATTCARTGPPSPSPAS
TSTPPSSPWRTTPPPRSRPCCATTPTTSPSTTTSRRPTCSTPSRPTPPTCPSPSPRATGPPSAAGPSRASRPARRPRSAPGSTPTSSTRA
PSPTSTAPSTSTTPSRRSPSPSTPPSAGPATTAS*RPTSSKSSAPSTERGTTWPSAT*PRTGSWSRCWPTTTSATRASTCPRATRTACT
PSSATSSP*AARSWTRSTTRTTRPSPWPTSTTTRASSATSRPPCARASPTPPTTPTRSSARAPSPASPRKSSSATGSCGASPSPATSCP
WARSPTSARTCSTPTPPTR*T*ISKSTPWMSPPFSMLSSKSSTSSECTSPTAASSRPSTCARPSRPATPPPKPLASCKMTACAGSGEQE
LRAILRDLGCGPCFLGTFDKRFPGFMAPHKLACAIVNTAGRETGGEHWLAFAWNPRSHTCYLFDPFGFSDERLKQIYQFEYEGLLRR
SALATEDRCVTLEKSTQTVQGPRSAACGLFCCMFLHAFVHWPDRPMDKNPTMNLLTGVPNGMLQSPQVEPTLRRNQEALYRFLN
AHSAYFRSHRARIEKATAFDRMNQDM*SGVCM*MLYSS**TAHVYATFSEALTLFRNRRGSAGSRHGPRAGIRCGTGTWAAT*TR
GSAASARGGRGTSRSTACA*VAGRPAGRARRS*NRSWDPRSARESYGTRGCSTGTPSGPGASRSPAPSRR*CPPRPDPRRWPSRR
GSSCRSAAPCWARSRACGCNRSAGGSASSGPARSSCPGTWPS*KPPAGGRPAAPCRPR*RRPRRTC*RTGWWRSQRRARSSARR
CWPAAPRCAPSGSG*SWPGRGSPSARAARSRSPHPSRSCAPSGSSRSRAGTAACPRPRCTRAATARSRCSPSSCGRSGSASARSPA
GSGPSSWSGSCCW*RSAECRGAPRSHTGGRYGGTPRPARASAGRRTSGRSPRGTGPSAASSLPCPSPRPKRSAGSGGSSPLSS*SPP
PKSGGRSRPGSQTLACRPSR*CARGES*SPRPPAPPRPAFRPCPG*CLAKAHAWSCGVSFWAAEAAAETCWASASSRSPRLFLLL
GRRPRPRGGRHASSGAEAEATGSRGSAGGWQSPFRVRGCAPGGAALTDFLRGRPLCSPREQAWRLSHRRQHRHLPPPPPTRTSSS
RMKA*PPRRPAPPPTPQPQTCKRWRNPSRLTWAT*RPRSTRRSWQRAFQPRKRTTKSSQSRKQRASRTRLGSSMATT*AGQRTC
SSSIWPANASSSRTRCSTAPRCPSAWRSSAAPTSATSSRRACPPSASPTAPASPTRASTSTRSSRCPRPWPPTTSFSRTKGSPSPAAPT
APAPATPCSTWAPAPAYLISPPWKRFPRSSRVWAATRLGPRTLCKEAERSMSTTAPWWSWKATTRAWRSSSARSS*PTSPTRRSTCP
PRS*APSWTRCSSSAPRPSRRRRCRTPRARTRASPWSATSSWRAGWERVAPPRAWKSGASS*WPWSW*PWSWSVCAASSPTR
RPCARSRRTCTTSSDTGSCARPARSPTWS*PTWSPTWASCTRTAWGRTCCTPPCAGRPAATTSATASTCTSATPGRRAWACGSSA
```

Fig. 22K

```
WRSRT*KSSASSCRRTSRPCGPGSTSAPPPRTWPTSSSPSACG*RCATGCPTL*AKACCKTFALSSSNAPGSCPPPAPRCPRTSCR*P
SASAPRRSGATATCCAWPTTWPTTRT*SRTSAARACSSATAAATSARRTAPWPATPSC*ARPRSSAPSSCKAPARARGV*NSPRGC
GPRPTCASSCPRTTIPSRSGSTRTNPSRPRPSCRPASSPRGPSWPNCKPSRNPAKNFC*KRATGSTWTPRPERSSTPASPRMPRGSS
KKLKVELPPPPEDLEEDWESSQAEEEEMEDWDSTQAEEDSLQDSLEEEDEVEEAEEEAAAARPSSSAEEEKASSTDTISAPGRGRGG
RAHSRWDETGRFPNPTTQTGKKERQGYKSWRGHKNAIVSCLQACGGNISFTRRYLLFHRGVNFPRNILHYYRHLHSPYYCFQEEAE
TQQQQQQQKTSGSS*KIHSGGRWTEDRGERAGADPGAEEPDLSHPLCHLPAESGARAGTESQEPFSALAHPQLSVSQERRPTSAH
SRGRRGSLQQVLRAHS*RVARARPHTEKGGNYVTTCALRPTIIMSKEIPTPYMWSYQPQMGLAAGAAQDYSTRMNWLSAGPAMI
SRVNDIRAHRNQILLEQSAITATPRHHLNPRNWPAALVYQEIPQPTTVLLPRDAQAEVQLTNSGVQLAGGAALCRHRPAQGIKRLVI
RGRGTQLNDEVVSSSLGLRPDGVFQLAGSGRSSFTPRQAVLTLESSSSQPRSGGIGTLQFVEEFTPSVYFNPFSGSPGHYPDEFIPNFD
AISESVDGYD*MSHGGAADLARLRHLDHCRRFRCFARDLAEFAYFELPEEHPQGPAHGVRIVVEGGLDSHLLRIFSQRPILAEREQG
QTLLTLYCICNHPGLHESLCCLLCTEYNKS*DQRLLRTSVCSCYQPVPVLHRERDRAPAPV*APQEVPHLAVPGLSDRRCQPLRQRRS
PAERPCQPYFFHPQKQAPALPTLPPRDLSVRLGTLPSHLPPDPEYHSVAPRY*QPNYPPTPPSRPRTCTELEKY*ATIHAHIRL*GRAT
ATHAPRY*LLQSNRRR*LTHWPTTTSTTFSWTWTAAPRSSDSPNFAFASSRREPSRSCRTA*PSTSARKASSAW*NRPRSPTRSPRP
TIASPTSSCSSARSSPAWSESTPSSSPSSRAIPRGASTAPATPPTASTL*SRPSAASATSSP*TNHPLIQ*NKYHIDDDLNKK*SFDLK*R
YNHIDDLSFKK*RITYLKSDTRSLSMFSANTTSLPSSQLWYCRPRRAANFLHTLKGMSNSSCPSIFILSSIRCPKSASGWMMTSTPSTPT
MQTTHRPCPSSTPPSSLQMDSKRSPWGCCPCDWLTPSPPRTGKSPSSWERGWTSTPRENSSPTRPPRPPPLSVFPTTPFPLTWIPLF
IPKMENYPYKFLHR*TY*NQPF*TH*L*LMDQV*D*VVALLLQYSWPLHSLLMKKEILKLT*PVVH*QLMQVDLVSTAKEGSLSLPQ
EMQLKAT*AGLKV*DLKVMA*LQTLAEDWNLEPLVQRLMSQMHTQFKLNWVLALPLTVQAPLLLGTKRMINLHYGPQPTPRQIA
KYTLKKMPNSHFA*QSVEVKFWVL*LYWQ*IMEVSTQSQTQ*ALHSSPSSLMQVEFC*AAPH*TKNIGTSEREMLHLLSPILML*VL
CLT*RPILKTHLQLQKAILSVKFISMGMRPNH*C*LLLLMKLRMQLAPTVSLFNGNGIVLSTQVKHLLPAPSPSPTSPKNEHCIPPCMP
TLPTPLCLWKKL*STK*NKVQVFY*FNSFTGFEQLFFLHPPRTWNTPPSPPAQP*TSECHW*WTCFWSPRSTQFQSEPVSGRSGR*
NPPGTPASAPHSSTAEDCPRWSGSRLSGRSRRAAVGIIVRERDRPVVSHQAPQQSLPPPLRQAAAQGVRVQGLPQHDAHGPQHQ
SSGAAGAAAHADLAQVAAVRATQDHQVVQQSIVQHAPAETHRGKDATHVAVVPDPQVNQVALPPEHAAHVHDLLGHVAVHHL
PVPHHPLVEHAAPDDPAEPQGQHRPARHAAKRPRVPAMAMEDPPLVPVDHLGAEQVYVGTAQAYAHASLQHSQLLGGQNHIP
GHGELLQDSEPRRTGQSSHITYIVHGQGIAIRQHRVILHQRSAGLGLLTAW*GGRPIRVMAGRG*SCSRPCHDAVAFGHFRTCCSRT
WSGRCTPIAGGGPGAWNARC*NCKTATLSDRAADLGPQERSHHAL*SHRPPWNGPDPAR*CNFVGFR*RRGREEQEEP*L
TFNPNGLGALQNEGRGDGTSRPRCVGGK*QPGQR*YGSRDVPRWLPAKPPRAHPETRQ*RKREGSLIPQSSCYTPAPSPDNFHFS
SLE*FELVPEVNPSQP**RARAERPPPAFLSTPS*FQDILLLVHLQQIDKRNIKISAAIPKLLPQQ*L*VLFHILSEIFSHRTTRNKIRASHS
TDKPKSSPVSIAKCKTAISMLARPGDIFQITGQKITQAIFKKINKRKILQVHV*SLGNNDEVNASGAFQHG*LADL*KTKNKTLNHASL
ANRWVNRSLQHQAGHGVSGATLVKIVAMIENHHRETFPVAGVNDSTR*IHPRNIGVRE*KKAPEEAIRHYNAQSQVQQSDAMR
MKHKILRCVQNVITPLLHRQRSPRSLQIHIQSLSVHSLPSSSTQQAQESEKG*ALTCPPALCSIYSPDLH*RKGQSLKIPAK*SHTPSTRP
ETGDTLKKIRALPQTPKLPSFPGSHATSSEFDFQIPSTVKNVTRPAPNGRPSLGQSPSSLPKFKQLICILTRTKSLRYIIDD
```

Fig. 23A

AdC7 010-HIVgag(E1048) Nucleic Acids – SEQ ID NO: 4

```
CATCATCAATAATATACCTCAAACTTTTGGTGCGCGTTAATATGCAAATGAGCTGTTTGAATTTGGGGAGGGAGGAAGGTGAT
TGGCCGAGAGACGGGCGACCGTTAGGGGCGGGGCGGGTGACGTTTTGATGACGTGGCCGTGAGGCGGAGCCGGTTTGCAA
GTTCTCGTGGGAAAAGTGACGTCAAACGAGGTGTGGTTTGAACACGGAAATACTCAATTTTCCCGCGCTCTCTGACAGGAAAT
GAGGTGTTTCTGGGCGGATGCAAGTGAAAACGGGCCATTTTCGCGCGAAAACTGAATGAGGAAGTGAAAATCTGAGTAATTT
CGCGTTTATGGCAGGGAGGAGTATTTGCCGAGGGCCGAGTAGACTTTGACCGATTACGTGGGGGTTTCGATTACCGTATTTTT
CACCTAAATTTCCGCGTACGGTGTCAAAGTCCGGTGTTTTTACGTACGATATCATTTCCCCGAAAGTGCCACCTGACCGTAACTA
TAACGGTCCTAAGGTAGCGAAAGCTCAGATCTCCCGATCCCCTATGGTGCACTCTCAGTACAATCTGCTCTGATGCCGCATAGT
TAAGCCAGTATCTGCTCCCTGCTTGTGTGTTGGAGGTCGCTGAGTAGTGCGCGAGCAAAATTTAAGCTACAACAAGGCAAGGC
TTGACCGACAATTGCATGAAGAATCTGCTTAGGGTTAGGCGTTTTGCGCTGCTTCGCGATGTACGGGCCAGATATACGCGTTG
ACATTGATTATTGACTAGTTATTAATAGTAATCAATTACGGGGTCATTAGTTCATAGCCCATATATGGAGTTCCGCGTTACATAA
CTTACGGTAAATGGCCCGCCTGGCTGACCGCCCAACGACCCCCGCCCATTGACGTCAATAATGACGTATGTTCCCATAGTAACG
CCAATAGGGACTTTCCATTGACGTCAATGGGTGGAGTATTTACGGTAAACTGCCCACTTGGCAGTACATCAAGTGTATCATATG
CCAAGTACGCCCCCTATTGACGTCAATGACGGTAAATGGCCCGCCTGGCATTATGCCCAGTACATGACCTTATGGGACTTTCCT
ACTTGGCAGTACATCTACGTATTAGTCATCGCTATTACCATGGTGATGCGGTTTTGGCAGTACATCAATGGGCGTGGATAGCG
GTTTGACTCACGGGGATTTCCAAGTCTCCACCCCATTGACGTCAATGGGAGTTTGTTTTGGCACCAAAATCAACGGGACTTTCC
AAAATGTCGTAACAACTCCGCCCCATTGACGCAAATGGGCGGTAGGCGTGTACGGTGGGAGGTCTATATAAGCAGAGCTCGT
TTAGTGAACCGTCAGATCACTAGAAGCTTTATTGCGGTAGTTTATCACAGTTAAATTGCTAACGCAGTCAGTGCTTCTGACACA
ACAGTCTCGAACTTAAGCTGCAGAAGTTGGTCGTGAGGCACTGGGCAGGTAAGTATCAAGGTTACAAGACAGGTTTAAGGAG
ACCAATAGAAACTGGGCTTGTCGAGACAGAGAAGACTCTTGCGTTTCTGATAGGCACCTATTGGTCTTACTGACATCCACTTTG
CCTTTCTCTCCACAGGTGTCCACTCCCAGTTCAATTACAGCTCTTAAGGCTAGAGTACTTAATACGACTCACTATAGGCTAGCGC
CACCATGGGCGCCAGAGCCAGCGTGCTGAGCGGGGAGAGCTGGATCGCTGGGAAAAGATTAGACTGAGGCCCGGAGGGA
AGAAAAAGTACAAGCTGAAACACATCGTGTGGGCCAGCAGGGAGCTGGAGCGCTTCGCCGTGAACCCCGGACTGCTGGAGA
CCTCCGAAGGCTGTCGGCAGATCCTGGGGCAGCTGCAGCCTTCCCTGCAGACAGGCTCCGAGGAGCTGCGGTCTCTGTATAAT
ACAGTGGCCACACTGTACTGTGTGCACCAGCGGATTGAGGTGAAGGATACAAAAGAGGCCCTGGAGAAGATTGAGGAGGAG
CAGAACAAGAGCAAGAAGAAAGCCCAGCAGGCCGCCGCCGACACCGGCAATAGCTCCCAGGTGAGCCAGAACTATCCAATTG
TGCAGAATCTGCAGGGCCAGATGGTGCACCAGGCCATTTCCCCACGGACACTGAACGCCTGGGTGAAGGTGGTGGAGGAGA
AGGCCTTCAGCCCCGAAGTGATCCCTATGTTTCCGCCCTGTCCGAAGGCGCCACCCCTCAGGACCTGAACACCATGCTGAACA
CAGTGGGGGGACACCAGGCCGCCATGCAGATGCTGAAGGAAACCATCAACGAGGAGGCCGCCGAGTGGGATCGGCTGCACC
CCGTGCACGCCGGGCCAATCGCCCCTGGCCAGATGAGGGAGCCCAGAGGCTCTGACATCGCCGGCACCACATCTACCCTGCA
GGAACAGATCGGGTGGATGACCAATAACCCACCAATCCCAGTGGGCGAGATCTACAAGAGGTGGATTATTCTGGGACTGAAC
AAAATTGTGCGCATGTATTCCCCTACATCCATCCTGGACATCAGGCAGGGCCCTAAGGAACCTTTCCGCGACTACGTGGATCGG
TTCTACAAAACCCTGCGCGCCGAGCAGGCCAGCCAGGAAGTGAAGAATTGGATGACAGAGACCCTGCTGGTGCAGAACGCCA
ATCCTGACTGTAAAACCATCCTGAAGGCCCTGGGCCCTGCCGCCACACTGGAGGAAATGATGACCGCCTGCCAGGGCGTGGG
CGGCCCTGGCCACAAAGCCAGGGTGCTGGCCGAGGCCATGTCTCAGGTGACCAACTCTGCCACAATTATGATGCAGCGGGGG
AACTTTCGGAACCAGAGGAAGACCGTGAAGTGCTTCAACTGTGGCAAGGAGGGACACATCGCCAAGAATTGCCGCGCCCCAC
GGAAGAAGGGGTGTTGGAAATGCGGGAAGGAGGGCCACCAGATGAAAGACTGCACAGAGCGGCAGGCCAACTTTCTGGGC
AAGATTTGGCCCAGCCACAAGGGCCGCCCCGGAAACTTTCTGCAGTCCAGGCCTGAGCCTACCGCCCCCCCTGAGGAATCCTT
CCGGTTCGGCGAGGAGACAACCACCCCAAGCCAGAAGCAGGAACCCATCGACAAAGAGCTGTACCCCCTGGCCAGCCTGAGA
TCCCTGTTCGGGAATGACCCCAGCTCTCAGTGATGATCTAGCGTTTAAACGGGCCCTCTAGAGTCGACCCGGGCGGCCAAACC
GCTGATCAGCCTCGACTGTGCCTTCTAGTTGCCAGCCATCTGTTGTTTGCCCCTCCCCCGTGCCTTCCTTGACCCTGGAAGGTGC
CACTCCCACTGTCCTTTCCTAATAAAATGAGGAAATTGCATCGCATTGTCTGAGTAGGTGTCATTCTATTCTGGGGGGTGGGGT
GGGGCAGGACAGCAAGGGGGAGGATTGGGAAGACAATAGCAGGCATGCTGGGGATGCGGTGGGCTCTATGGCTTCTGAGG
CGGAAAGAACCAGCAGATCTGCAGATCTGAATTCATCTATGTCGGGTGCGGAGAAGAGGTAATGAAATGGCATTATGGGTA
TTATGGGTCTGCATTAATGAATCGGCCAGATATGCTGGCCACCGTGCATGTGACCTCGCACCCCCGCAAGACATGGCCCGAGT
TCGAGCACAACGTCATGACCCGATGCAATGTGCACCTGGGGTCCGCCGAGGCATGTTCATGCCCTACCAGTGCAACATGCAA
TTTGTGAAGGTGCTGCTGGAGCCCGATGCCATGTCCAGAGTGAGCCTGACGGGGGTGTTTGACATGAATGTGGAGCTGTGGA
AAATTCTGAGATATGATGAATCCAAGACCAGGTGCCGGGCCTGCGAATGCGGAGGCAAGCACGCCAGGCTTCAGCCCGTGTG
TGTGGAGGTGACGGAGGACCTGCGACCCGATCATTTGGTGTTGTCCTGCAACGGGACGGAGTTCGGCTCCAGCGGGGAAGA
ATCTGACTAGAGTGAGTAGTGTTTGGGGGAGGTGGAGGGCTTGTATGAGGGGCAGAATGACTAAAATCTGTGTTTTTCTGTG
```

Fig. 23B

```
TGTTGCAGCAGCATGAGCGGAAGCGCCTCCTTTGAGGGAGGGGTATTCAGCCCTTATCTGACGGGGCGTCTCCCCTCCTGGGC
GGGAGTGCGTCAGAATGTGATGGGATCCACGGTGGACGGCCGGCCCGTGCAGCCCGCGAACTCTTCAACCCTGACCTACGCG
ACCCTGAGCTCCTCGTCCGTGGACGCAGCTGCCGCCGCAGCTGCTGCTTCCGCCGCCAGCGCCGTGCGCGGAATGGCCCTGGG
CGCCGGCTACTACAGCTCTCTGGTGGCCAACTCGACTTCCACCAATAATCCCGCCAGCCTGAACGAGGAGAAGCTGCTGCTGC
TGATGGCCCAGCTCGAGGCCCTGACCCAGCGCCTGGGCGAGCTGACCCAGCAGGTGGCTCAGCTGCAGGCGGAGACGCGGG
CCGCGGTTGCCACGGTGAAAACCAAATAAAAAATGAATCAATAAATAAACGGAGACGGTTGTTGATTTTAACACAGAGTCTTG
AATCTTTATTTGATTTTTCGCGCGCGGTAGGCCCTGGACCACCGGTCTCGATCATTGAGCACCCGGTGGATTTTTTCCAGGACC
CGGTAGAGGTGGGCTTGGATGTTGAGGTACATGGGCATGAGCCCGTCCCGGGGGTGGAGGTAGCTCCATTGCAGGGCCTCG
TGCTCGGGGGTGGTGTTGTAAATCACCCAGTCATAGCAGGGGCGCAGGGCGTGGTGCTGCACGATGTCCTTGAGGAGGAGA
CTGATGGCCACGGGCAGCCCCTTGGTGTAGGTGTTGACGAACCTGTTGAGCTGGGAGGGATGCATGCGGGGGGAGATGAGA
TGCATCTTGGCCTGGATCTTGAGATTGGCGATGTTCCCGCCCAGATCCCGCCGGGGGTTCATGTTGTGCAGGACCACCAGCAC
GGTGTATCCGGCGCACTTGGGGAATTTGTCATGCAACTTGGAAGGGAAGGCGTGAAAGAATTTGGAGACGCCCTTGTGACCG
CCCAGGTTTTCCATGCACTCATCCATGATGATGGCGATGGGCCCGTGGGCGGCGGCCTGGGCAAAGACGTTTCGGGGGTCGG
ACACATCGTAGTTGTGGTCCTGGGTGAGCTCGTCATAGGCCATTTTAATGAATTTGGGGCGGAGGGTGCCCGACTGGGGGAC
GAAGGTGCCCTCGATCCCGGGGCGTAGTTGCCCTCGCAGATCTGCATCTCCCAGGCCTTGAGCTCGGAGGGGGGATCATG
TCCACCTGCGGGGCGATGAAAAAAACGGTTTCCGGGGCGGGGAGATGAGCTGGGCCGAAAGCAGGTTCCGGAGCAGCTG
GGACTTGCCGCAGCCGGTGGGGCCGTAGATGACCCCGATGACCGGCTGCAGGTGGTAGTTGAGGGAGAGACAGCTGCCGTC
CTCGCGGAGGAGGGGGGCCACCTCGTTCATCATCTCGCGCACATGCATGTTCTCGCGCACGAGTTCCGCCAGGAGGCGCTCGC
CCCCCAGCGAGAGGAGCTCTTGCAGCGAGGCGAAGTTTTTCAGCGGCTTGAGCCCGTCGGCCATGGGCATTTTGGAGAGGGT
CTGTTGCAAGAGTTCCAGACGGTCCCAGAGCTCGGTGATGTGCTCTAGGGCATCTCGATCCAGCAGACCTCCTCGTTTCGCGG
GTTGGGGCGACTGCGGGAGTAGGGCACCAGGCGATGGGCGTCCAGCGAGGCCAGGGTCCGGTCCTTCCAGGGTCGCAGGGT
CCGCGTCAGCGTGGTCTCCGTCACGGTGAAGGGGTGCGCGCCGGGCTGGGCGCTTGCGAGGGTGCGCTTCAGGCTCATCCGG
CTGGTCGAGAACCGCTCCCGGTCGGCGCCCTGCGCGTCGGCCAGGTAGCAATTGAGCATGAGTTCGTAGTTGAGCGCCTCGG
CCGCGTGGCCCTTGGCGCGGAGCTTACCTTTGGAAGTGTGTCCGCAGACGGGACAGAGGAGGGACTTGAGGGCGTAGAGCT
TGGGGGCGAGGAAGACGGACTCGGGGGCGTAGGCGTCCGCGCCGCAGCTGGCGCAGACGGTCTCGCACTCCACGAGCCAG
GTGAGGTCGGGCCGGTTGGGGTCAAAAACGAGGTTTCCTCCGTGCTTTTTGATGCGTTTCTTACCTCTGGTCTCCATGAGCTCG
TGTCCCCGCTGGGTGACAAAGAGGCTGTCCGTGTCCCCGTAGACCGACTTTATGGGCCGGTCCTCGAGCGGGGTGCCGCGGT
CCTCGTCGTAGAGGAACCCCGCCCACTCCGAGACGAAGGCCCGGGTCCAGGCCAGCACGAAGGAGGCCACGTGGGAGGGGT
AGCGGTCGTTGTCCACCAGCGGGTCCACCTTCTCCAGGGTATGCAAGCACATGTCCCCCTCGTCCACATCCAGGAAGGTGATT
GGCTTGTAAGTGTAGGCCACGTGACCGGGGGTCCCGGCCGGGGGGTATAAAAGGGGGCGGGCCCCTGCTCGTCCTCACTG
TCTTCCGGATCGCTGTCCAGGAGCGCCAGCTGTTGGGGTAGGTATTCCCTCTCGAAGGCTGGCATAACCTCGGCACTCAGGTT
GTCAGTTTCTAGAAACGAGGAGGATTTGATATTGACGGTGCCGTTGGAGACGCCTTTCATGAGCCCCTCGTCCATCTGGTCAG
AAAAGACGATCTTTTTGTTGTCGAGCTTGGTGGCGAAGGAGCCGTAGAGGGCGTTGGAGAGGAGCTTGGCGATGGAGCGCA
TGGTCTGGTTCTTTTCCTTGTCGGCGCGCTCCTTGGCGGCGATGTTGAGCTGCACGTACTCGCGCGCCACGCACTTCCATTCGG
GGAAGACGGTGGTGAGCTCGTCGGGCACGATTCTGACCCGCCAGCCGCGGTTGTGCAGGGTGATGAGGTCCACGCTGGTGG
CCACCTCGCCGCGCAGGGGCTCGTTGGTCCAGCAGAGGCGCCCGCCCTTGCGCGAGCAGAAGGGGGGCAGCGGGTCCAGCA
TGAGCTCGTCGGGGGGTCGGCGTCCACGGTGAAGATGCCGGGCAGAAGCTCGGGGTCGAAGTAGCTGATGCAGGTGTCCA
GATCGTCCAGCGCCGCTTGCCAGTCGCGCACGGCCAGCGCGCGCTCGTAGGGGCTGAGGGGCGTGCCCCAGGGCATGGGGT
GCGTGAGCGCGGAGGCGTACATGCCGCAGATGTCGTAGACGTAGAGGGGCTCCTCGAGGACGCCGATGTAGGTGGGGTAGC
AGCGCCCCCGCGGATGCTGGCGCGCACGTAGTCGTACAGCTCGTGCGAGGGCGCGAGGAGCCCCGTGCCGAGGTTGGAGC
GTTGCGGCTTTTCGGCGCGGTAGACGATCTGGCGGAAGATGGCGTGGGAGTTGGAGGAGATGGTGGGCCTCTGGAAGATGT
TGAAGTGGGCGTGGGGCAGGCCGACCGAGTCCCTGATGAAGTGGGCGTAGGAGTCCTGCAGCTTGGCGACGAGCTCGGCGG
TGACGAGGACGTCCAGGGCGCAGTAGTCGAGGGTCTCTTGGATGATGTCGTACTTGAGCTGGCCCTTCTGCTTCCACAGCTCG
CGGTTGAGAAGGAACTCTTCGCGGTCCTTCCAGTACTCTTCGAGGGGAACCCGTCCTGATCGGCACGGTAAGAGCCCACCAT
GTAGAACTGGTTGACGGCCTTGTAGGCGCAGCAGCCCTTCTCCACGGGGAGGGCGTAAGCTTGTGCGGCCTTGCGCAGGGAG
GTGTGGGTGAGGGCGAAGGTGTCGCGCACCATGACCTTGAGGAACTGGTGCTTGAAGTCGAGGTCGTCGCAGCCGCCCTGCT
CCCAGAGCTGGAAGTCCGTGCGCTTCTTGTAGGCGGGGTTGGGCAAAGCGAAAGTAACATCGTTGAAGAGGATCTTGCCCGC
GCGGGGCATGAAGTTGCGAGTGATGCGGAAAGGCTGGGGCACCTCGGCCCGGTTGTTGATGACCTGGGCGGCGAGGACGAT
CTCGTCGAAGCCGTTGATGTTGTGCCCGACGATGTAGAGTTCCACGAATCGCGGGCGGCCCTTAACGTGGGGCAGCTTCTTGA
GCTCGTCGTAGGTGAGCTCGGCGGGGTCGCTGAGCCCGTGCTGCTCGAGGGCCCAGTCGGCGACGTGGGGGTTGGCGCTGA
GGAAGGAAGTCCAGAGATCCACGGCCAGGGCGGTCTGCAAGCGGTCCGGTACTGACGGAACTGCTGGCCCACGGCCATTTT
```

Fig. 23C

```
TTCGGGGGTGACGCAGTAGAAGGTGCGGGGGTCGCCGTGCCAGCGGTCCCACTTGAGCTGGAGGGCGAGGTCGTGGGCGA
GCTCGACGAGCGGCGGGTCCCCGGAGAGTTTCATGACCAGCATGAAGGGGACGAGCTGCTTGCCGAAGGACCCCATCCAGGT
GTAGGTTTCCACATCGTAGGTGAGGAAGAGCCTTTCGGTGCGAGGATGCGAGCCGATGGGGAAGAACTGGATCTCCTGCCAC
CAGTTGGAGGAATGGCTGTTGATGTGATGGAAGTAGAAATGCCGACGGCGCGCCGAGCACTCGTGCTTGTGTTTATACAAGC
GTCCGCAGTGCTCGCAACGCTGCACGGGATGCACGTGCTGCACGAGCTGTACCTGGGTTCCTTTGACGAGGAATTTCAGTGGG
CAGTGGAGCGCTGGCGGCTGCATCTGGTGCTGTACTACGTCCTGGCCATCGGCGTGGCCATCGTCTGCCTCGATGGTGGTCAT
GCTGACGAGCCCGCGCGGGAGGCAGGTCCAGACTTCGGCTCGGACGGGTCGGAGAGCGAGGACGAGGGCGCGCAGGCCGG
AGCTGTCCAGGGTCCTGAGACGCTGCGGAGTCAGGTCAGTGGGCAGCGGCGGCGCGCGGTTGACTTGCAGGAGCTTTTCCAG
GGCGCGCGGGAGGTCCAGATGGTACTTGATCTCCACGGCGCCGTTGGTGGCGACGTCCACGGCTTGCAGGGTCCCGTGCCCC
TGGGGCGCCACCACCGTGCCCCGTTTCTTCTTGGGCGCTGCTTCCATGCCGGTCAGAAGCGGCGGCGAGGACGCGCGCCGGG
CGGCAGGGCGGCTCGGGACCCGGAGGCAGGGCGGCAGGGGCACGTCGGCGCCGCGCGCGGGCAGGTTCTGGTACTGCG
CCCGGAGAAGACTGGCGTGAGCGACGACGCGACGGTTGACGTCCTGGATCTGACGCCTCTGGGTGAAGGCCACGGGACCCG
TGAGTTTGAACCTGAAAGAGAGTTCGACAGAATCAATCTCGGTATCGTTGACGGCGGCCTGCCGCAGGATCTCTTGCACGTCG
CCCGAGTTGTCCTGGTAGGCGATCTCGGTCATGAACTGCTCGATCTCCTCCTCCTGAAGGTCTCCGCGGCCGGCGCGCTCGAC
GGTGGCCGCGAGGTCGTTGGAGATGCGGCCCATGAGCTGCGAGAAGGCGTTCATGCCGGCCTCGTTCCAGACGCGGCTGTA
GACCACGGCTCCGTCGGGTCGCGCGCGCGCATGACCACCTGGGCGAGGTTGAGCTCGACGTGGCGCGTGAAGACCGCGTA
GTTGCAGAGGCGCTGGTAGAGGTAGTTGAGCGTGGTGGCGATGTGCTCGGTGACGAAGAAGTACATGATCCAGCGGCGGAG
CGGCATCTCGCTGACGTCGCCCAGGGCTTCCAAGCGCTCCATGGCCTCGTAGAAGTCCACGGCGAAGTTGAAAAACTGGGAG
TTGCGCGCCGAGACGGTCAACTCCTCCTCCAGAAGACGGATGAGCTCAGCGATGGTGGCGCGCACCTCGCGCTCGAAGGCCC
CGGGGGGCTCCTCTTCTTCCATCTCTTCCTCCTCCACTAACATCTCTTCTACTTCCTCCTCAGGAGGCGGCGGCGGGGGAGGGG
CCCTGCGTCGCCGGCGGCGCACGGGCAGACGGTCGATGAAGCGCTCGATGGTCTCCCCGCGCCGGCGACGCATGGTCTCGGT
GACGGCGCGCCCGTCCTCGCGGGGCCGCAGCGTGAAGACGCCGCCGCGCATCTCCAGGTGGCCGCCGGGGGGGTCTCCGTT
GGGCAGGGAGAGGGCGCTGACGATGCATCTTATCAATTGGCCCGTAGGGACTCCGCGCAAGGACCTGAGCGTCTCGAGATCC
ACGGGATCCGAAAACCGCTGAACGAAGGCTTCGAGCCAGTCGCAGTCGCAAGGTAGGCTGAGCCCGGTTTCTTGTTCTTCGG
GGATTTCGGGAGGCGGGCGGGCGATGCTGCTGGTGATGAAGTTGAAGTAGGCGGTCCTGAGACGGCGGATGGTGGCGAGG
AGCACCAGGTCCTTGGGCCCGGCTTGCTGGATGCGCAGACGGTCGGCCATGCCCCAGGCGTGGTCCTGACACCTGGCGAGGT
CCTTGTAGTAGTCCTGCATGAGCCGCTCCACGGGCACCTCCTCCTCGCCCGCGCGGCCGTGCATGCGCGTGAGCCCGAACCCG
CGCTGGGGCTGGACGAGCGCCAGGTCGGCGACGACGCGCTCGGCGAGGATGGCCTGCTGTATCTGGGTGAGGGTGGTCTGG
AAGTCGTCGAAGTCGACGAAGCGGTGGTAGGCTCCGGTGTTGATGGTATAGGAGCAGTTGGCCATGACGGACCAGTTGACG
GTCTGGTGGCCGGGTCGCACGAGCTCGTGGTACTTGAGGCGCGAGTAGGCGCGCGTGTCGAAGATGTAGTCGTTGCAGGTG
CGCACGAGGTACTGGTATCCGACGAGGAAGTGCGGCGGCGGCTGGCGGTAGAGCGGCCATCGCTCGGTGGCGGGGGCGCC
GGGCGCGAGGTCCTCGAGCATGAGGCGGTGGTAGCCGTAGATGTACCTGGACATCCAGGTGATGCCGGCGGCGGTGGTGGA
GGCGCGCGGGAACTCGCGGACGCGGTTCCAGATGTTGCGCAGCGGCAGGAAGTAGTTCATGGTGGCCGCGGTCTGGCCCGT
GAGGCGCGCGCAGTCGTGGATGCTCTAGACATACGGGCAAAAACGAAAGCGGTCAGCGGCTCGACTCCGTGGCCTGGAGGC
TAAGCGAACGGGTTGGGCTGCGCGTGTACCCCGGTTCGAATCTCGAATCAGGCTGGAGCCGCAGCTAACGTGGTACTGGCAC
TCCCGTCTCGACCCAAGCCTGCTAACGAAACCTCCAGGATACGGAGGCGGGTCGTTTTTTGGCCTTGGTCGCTGGTCATGAAA
AACTAGTAAGCGCGGAAAGCGACCGCCCGCGATGGCTCGCTGCCGTAGTCTGGAGAAAGAATCGCCAGGGTTGCGTTGCGGT
GTGCCCCGGTTCGAGCCTCAGCGCTCGGCGCCGGCCGGATTCCGCGGCTAACGTGGGCGTGGCTGCCCCGTCGTTTCCAAGAC
CCCTTAGCCAGCCGACTTCTCCAGTTACGGAGCGAGCCCTCTTTTTCTTGTGTTTTTGCCAGATGCATCCCGTACTGCGGCAGA
TGCGCCCCACCCTCCACCTCAACCGCCCCTACCGCCGCAGCAGCAGCAACAGCCGGCGCTTCTGCCCCGCCCCAGCAGCAGC
CAGCCACTACCGCGGCGGCCGCCGTGAGCGGAGCCGGCGTTCAGTATGACCTGGCCTTGGAAGAGGGCGAGGGGCTGGCGC
GGCTGGGGCGTCGTCGCCGGAGCGGCACCCGCGCGTGCAGATGAAAAGGGACGCTCGCGAGGCCTACGTGCCCAAGCAGA
ACCTGTTCAGAGACAGGAGCGGCGAGGAGCCCGAGGAGATGCGCGCCTCCCGCTTCCACGCGGGGCGGGAGCTGCGGCGCG
GCCTGGACCGAAAGCGGGTGCTGAGGGACGAGGATTTCGAGGCGGACAGCTGACGGGATCAGCCCCGCGCGCGCAC
GTGGCCGCGGCCAACCTGGTCACGGCGTACGAGCAGACCGTGAAGGAGGAGCAACTTCCAAAAATCCTTCAACAACCACG
TGCGCACGCTGATCGCGCGCGAGGAGGTGACCCTGGGCCTGATGCACCTGTGGGACCTGCTGGAGGCCATCGTGCAGAACCC
CACGAGCAAGCCGCTGACGGCGCAGCTGTTTCTGGTGGTGCAGCACAGTCGGGACAACGAGACGTTCAGGGAGGCGCTGCT
GAATATCACCGAGCCCGAGGGCCGCTGGCTCCTGGACCTGGTGAACATTCTGCAGAGCATCGTGGTGCAGGAGCGCGGGCTG
CCGCTGTCCGAGAAGCTGGCGGCTATCAACTTCTCGGTGCTGAGCCTGGGCAAGTACTACGCTAGGAAGATCTACAAGACCCC
GTACGTGCCCATAGACAAGGAGGTGAAGATCGACGGGTTTTACATGCGCATGACCCTGAAAGTGCTGACCCTGAGCGACGAT
CTGGGGGTGTACCGCAACGACAGGATGCACCGCGCGGTGAGCGCCAGCCGCCGGCGCGAGCTGAGCGACCAGGAGCTGATG
```

Fig. 23D

```
CACAGCCTGCAGCGGGCCCTGACCGGGGCCGGGACCGAGGGGGAGAGCTACTTTGACATGGGCGCGGACCTGCGCTGGCAG
CCCAGCCGCCGGGCCTTGGAAGCTGCCGGCGGTTCCCCCTACGTGGAGGAGGTGGACGATGAGGAGGAGGAGGGCGAGTAC
CTGGAAGACTGATGGCGCGACCGTATTTTTGCTAGATGCAGCAACAGCCACCGCCTCCTGATCCCGCGATGCGGGCGGCGCTG
CAGAGCCAGCCGTCCGGCATTAACTCCTCGGACGATTGGACCCAGGCCATGCAACGCATCATGGCGCTGACGACCCGCAATCC
CGAAGCCTTTAGACAGCAGCCTCAGGCCAACCGGCTCTCGGCCATCCTGGAGGCCGTGGTGCCCTCGCGCTCGAACCCCACGC
ACGAGAAGGTGCTGGCCATCGTGAACGCGCTGGTGGAGAACAAGGCCATCCGCGGCGACGAGGCCGGGCTGGTGTACAACG
CGCTGCTGGAGCGCGTGGCCCGCTACAACAGCACCAACGTGCAGACGAACCTGGACCGCATGGTGACCGACGTGCGCGAGG
CGGTGTCGCAGCGCGAGCGGTTCCACCGCGAGTCGAACCTGGGCTCCATGGTGGCGCTGAACGCCTTCCTGAGCACGCAGCC
CGCCAACGTGCCCCGGGGCCAGGAGGACTACACCAACTTCATCAGCGCGCTGCGGCTGATGGTGGCCGAGGTGCCCCAGAGC
GAGGTGTACCAGTCGGGGCCGGACTACTTCTTCCAGACCAGTCGCCAGGGCTTGCAGACCGTGAACCTGAGCCAGGCTTTCAA
GAACTTGCAGGGACTGTGGGGCGTGCAGGCCCCGGTCGGGGACCGCGCGACGGTGTCGAGCCTGCTGACGCCGAACTCGCG
CCTGCTGCTGCTGCTGGTGGCGCCCTTCACGGACAGCGGCAGCGTGAGCCGCGACTCGTACCTGGGCTACCTGCTTAACCTGT
ACCGCGAGGCCATCGGGCAGGCGCACGTGGACGAGCAGACCTACCAGGAGATCACCCACGTGAGCCGCGCGCTGGGCCAGG
AGGACCCGGGCAACCTGGAGGCCACCCTGAACTTCCTGCTGACCAACCGGTCGCAGAAGATCCCGCCCCAGTACGCGCTGAG
CACCGAGGAGGAGCGCATCCTGCGCTACGTGCAGCAGAGCGTGGGGCTGTTCCTGATGCAGGAGGGGGCCACGCCCAGCGC
CGCGCTCGACATGACCGCGCGCAACATGGAGCCCAGCATGTACGCTCGCAACCGCCCGTTCATCAATAAGCTGATGGACTACT
TGCATCGGGCGGCCGCCATGAACTCGGACTACTTTACCAACGCCATCTTGAACCCGCACTGGCTCCCGCCGCCCGGGTTCTACA
CGGGCGAGTACGACATGCCCGACCCCAACGACGGGTTCCTGTGGGACGACGTGGACAGCAGCGTGTTCTCGCCGCGCCCCGC
CACCACCGTGTGGAAGAAAGAGGGCGGGGACCGGCGGCCGTCCTCGGCGCTGTCCGGTCGCGCGGGTGCTGCCGCGGCGGT
GCCTGAGGCCGCCAGCCCCTTCCCGAGCCTGCCCTTTTCGCTGAACAGCGTGCGCAGCAGCGAGCTGGGTCGGCTGACGCGG
CCGCGCCTGCTGGGCGAGGAGGAGTACCTGAACGACTCCTTGTTGAGGCCCGAGCGCGAGAAGAACTTCCCCAATAACGGGA
TAGAGAGCCTGGTGGACAAGATGAGCCGCTGGAAGACGTACGCGCACGAGCACAGGGACGAGCCCCGAGCTAGCAGCAGCG
CAGGCACCCGTAGACGCCAGCGACACGACAGGCAGCGGGGTCTGGTGTGGGACGATGAGGATTCCGCCGACGACAGCAGCG
TGTTGGACTTGGGTGGGAGTGGTGGTGGTAACCCGTTCGCTCACTTGCGCCCCCGTATCGGGCGCCTGATGTAAGAATCTGAA
AAAATAAAAAACGGTACTCACCAAGGCCATGGCGACCAGCGTGCGTTCTTCTCTGTTGTTTGTAGTAGTATGATGAGGCGCGT
GTACCCGGAGGGTCCTCCTCCCTCGTACGAGAGCGTGATGCAGCAGGCGGTGGCGGCGGCGATGCAGCCCCGCTGGAGGC
GCCTTACGTGCCCCGCGGTACCTGGCGCCTACGGAGGGGCGGAACAGCATTCGTTACTCGGAGCTGGCACCCTTGTACGATA
CCACCCGGTTGTACCTGGTGGACAACAAGTCGGCGGACATCGCCTCGCTGAACTACCAGAACGACCACAGCAACTTCCTGACC
ACCGTGGTGCAGAACAACGATTTCACCCCCACGGAGGCCAGCACCCAGACCATCAACTTTGACGAGCGCTCGCGGTGGGGCG
GCCAGCTGAAAACCATCATGCACACCAACATGCCCAACGTGAACGAGTTCATGTACAGCAACAAGTTCAAGGCGCGGGTGAT
GGTCTCGCGCAAGACCCCCAATGGGGTCGCGGTGGATGAGAATTATGATGGTAGTCAGGACGAGCTGACTTACGAGTGGGTG
GAGTTTGAGCTGCCCGAGGGCAACTTCTCGGTGACCATGACCATCGATCTGATGAACAACGCCATCATCGACAACTACTTGGC
GGTGGGGCGTCAGAACGGGGTGCTGGAGAGCGACATCGGCGTGAAGTTCGACACGCGCAACTTCCGGCTGGGCTGGGACCC
CGTGACCGAGCTGGTGATGCCGGGCGTGTACACCAACGAGGCCTTCCACCCCGACATCGTCCTGCTGCCCGGCTGCGGCGTG
GACTTCACCGAGAGCCGCCTCAGCAACCTGCTGGGCATCCGCAAGCGGCAGCCCTTCCAGGAGGGCTTCCAGATCCTGTACGA
GGACCTGGAGGGGGGCAACATCCCCGCGCTCTTGGATGTCGAAGCCTATGAGAAAAGCAAGGAGGAGGCCGCCGCAGCGGC
GACCGCAGCCGTGGCCACCGCCTCTACCGAGGTGCGGGGCGATAATTTTGCTAGCGCCGCGGCAGTGGCCGAGGCGGCTGAA
ACCGAAAGTAAGATAGTCATCCAGCCGGTGGAGAAGGACAGCAAGGACAGGAGCTACAACGTGCTCGCGGACAAGAAAAAC
ACCGCCTACCGCAGCTGGTACCTGGCCTACAACTACGGCGACCCCGAGAAGGGCGTGCGCTCCTGGACGCTGCTCACCACCTC
GGACGTCACCTGCGGCGTGGAGCAAGTCTACTGGTCGCTGCCCGACATGATGCAAGACCCGGTCACCTTCCGCTCCACGCGTC
AAGTTAGCAACTACCCGGTGGTGGGCGCCGAGCTCCTGCCCGTCTACTCCAAGAGCTTCTTCAACGAGCAGGCCGTCTACTCG
CAGCAGCTGCGCGCCTTCACCTCGCTCACGCACGTCTTCAACCGCTTCCCCGAGAACCAGATCCTCGTCCGCCCGCCCGCGCCC
ACCATTACCACCGTCAGTGAAAACGTTCCTGCTCTCACAGATCACGGGACCCTGCCGCTGCGCAGCAGTATCCGGGGAGTCCA
GCGCGTGACCGTCACTGACGCCAGACGCCGCACCTGCCCCTACGTCTACAAGGCCCTGGGCGTAGTCGCGCCGCGCGTCCTCT
CGAGCCGCACCTTCTAAAAAATGTCCATTCTCATCTCGCCCAGTAATAACACCGGTTGGGGCCTGCGCGCGCCCAGCAAGATGT
ACGGAGGCGCTCGCCAACGCTCCACGCAACACCCCGTGCGCGTGCGCGGGCACTTCCGCGCTCCCTGGGGCGCCCTCAAGGG
CCGCGTGCGCTCGCGCACCACCGTCGACGACGTGATCGACCAGGTGGTGGCCGACGCGCGCAACTACACGCCCGCCGCCGCG
CCCGCCTCCACCGTGGACGCCGTCATCGACAGCGTGGTGGCCGATGCGCGCCGGTACGCCCGCGCCAAGAGCCGGCGGCGGC
GCATCGCCCGGCGGCACCGGAGCACCCCCGCCATGCGCGCGGGCGCGAGCCTTGCTGCGCAGGGCCAGGCGCACGGGACGCA
GGGCCATGCTCAGGGCGGCCAGACGCGCGGCCTCCGGCAGCAGCAGCGCCGGCAGGACCCGCAGACGCGCGGCCACGGCG
GCGGCGGCGGCCATCGCCAGCATGTCCGCCCGCGGCGCGGCAACGTGTACTGGGTGCGCGACGCCGCCACCGGTGTGCGC
```

Fig. 23E

```
GTGCCCGTGCGCACCCGCCCCCCTCGCACTTGAAGATGCTGACTTCGCGATGTTGATGTGTCCCAGCGGCGAGGAGGATGTCC
AAGCGCAAATACAAGGAAGAGATGCTCCAGGTCATCGCGCCTGAGATCTACGGCCCCGCGGTGAAGGAGGAAAGAAAGCCC
CGCAAACTGAAGCGGGTCAAAAAGGACAAAAAGGAGGAGGAAGATGTGGACGGACTGGTGGAGTTTGTGCGCGAGTTCGC
CCCCCGGCGGCGCGTGCAGTGGCGCGGGCGGAAAGTGAAACCGGTGCTGCGGCCCGGCACCACGGTGGTCTTCACGCCCGG
CGAGCGTTCCGGCTCCGCCTCCAAGCGCTCCTACGACGAGGTGTACGGGGACGAGGACATCCTCGAGCAGGCGGTCGAGCGT
CTGGGCGAGTTTGCTTACGGCAAGCGCAGCCGCCCCGCGCCCTTGAAAGAGGAGGCGGTGTCCATCCCGCTGGACCACGGCA
ACCCCACGCCGAGCCTGAAGCCGGTGACCCTGCAGCAGGTGCTGCCGAGCGCGGCGCCGCGCCGGGGCTTCAAGCGCGAGG
GCGGCGAGGATCTGTACCCGACCATGCAGCTGATGGTGCCCAAGCGCCAGAAGCTGGAGGACGTGCTGGAGCACATGAAGG
TGGACCCCGAGGTGCAGCCCGAGGTCAAGGTGCGGCCCATCAAGCAGGTGGCCCCGGGCCTGGGCGTGCAGACCGTGGACA
TCAAGATCCCCACGGAGCCCATGGAAACGCAGACCGAGCCCGTGAAGCCCAGCACCAGCACCATGGAGGTGCAGACGGATCC
CTGGATGCCGGCGCCGGCTTCCACCACTCGCCGAAGACGCAAGTACGGCGCGGCCAGCCTGCTGATGCCCAACTACGCGCTG
CATCCTTCCATCATCCCCACGCCGGGCTACCGCGGCACGCGCTTCTACCGCGGCTACACCAGCAGCCGCCGCAAGACCACCACC
CGCCGCCGCCGTCGTCGCACCCGCCGCAGCAGCACCGCGACTTCCGCCGCCGCCCTGGTGCGGAGAGTGTACCGCAGCGGGC
GCGAGCCTCTGACCCTGCCGCGCGCGCGCTACCACCCGAGCATCGCCATTTAACTCTGCCGTCGCCTCCTACTTGCAGATATGG
CCCTCACATGCCGCCTCCGCGTCCCCATTACGGGCTACCGAGGAAGAAAGCCGCGCCGTAGAAGGCTGACGGGGAACGGGCT
GCGTCGCCATCACCACCGGCGGCGGCGCGCCATCAGCAAGCGGTTGGGGGGAGGCTTCCTGCCCGCGCTGATCCCCATCATC
GCCGCGGCGATCGGGGCGATCCCCGGCATAGCTTCCGTGGCGGTGCAGGCCTCTCAGCGCCACTGAGACACAGCTTGGAAAA
TTTGTAATAAAAAAATGGACTGACGCTCCTGGTCCTGTGATGTGTGTTTTTAGATGGAAGACATCAATTTTTCGTCCCTGGCAC
CGCGACACGGCACGCGGCCGTTTATGGGCACCTGGAGCGACATCGGCAACAGCCAACTGAACGGGGGCGCCTTCAATTGGAG
CAGTCTCTGGAGCGGGCTTAAGAATTTCGGGTCCACGCTCAAAACCTATGGCAACAAGGCGTGGAACAGCAGCACAGGGCAG
GCGCTGAGGGAAAAGCTGAAAGAGCAGAACTTCCAGCAGAAGGTGGTCGATGGCCTGGCCTCGGGCATCAACGGGGTGGTG
GACCTGGCCAACCAGGCCGTGCAGAAACAGATCAACAGCCGCCTGGACGCGGTCCCGCCCGCGGGGTCCGTGGAGATGCCCC
AGGTGGAGGAGGAGCTGCCTCCCCTGGACAAGCGCGGCGACAAGCGACCGCGTCCCGACGCGGAGGAGACGCTGCTGACGC
ACACGGACGAGCCGCCCCGTACGAGGAGGCGGTGAAACTGGGTCTGCCCACCACGCGGCCCGTGGCGCCTCTGGCCACCGG
GGTGCTGAAACCCAGCAGCAGCAGCCAGCCCGCGACCCTGGACTTGCCTCCGCCTGCTTCCCGCCCCTCCACAGTGGCTAAGC
CCCTGCCGCCGGTGGCCGTCGCGTCGCGCGCCCCCGAGGCCGCCCCCAGGCGAACTGGCAGAGCACTCTGAACAGCATCGT
GGGTCTGGGAGTGCAGAGTGTGAAGCGCCGCCGCTGCTATTAAAAGACACTGTAGCGCTTAACTTGCTTGTCTGTGTGTATAT
GTATGTCCGCCGACCAGAAGGAGGAAGAGGCGCGTCGCCGAGTTGCAAGATGGCCACCCCATCGATGCTGCCCCAGTGGGC
GTACATGCACATCGCCGGACAGGACGCTTCGGAGTACCTGAGTCCGGGTCTGGTGCAGTTCGCCCGCGCCACAGACACCTACT
TCAGTCTGGGGAACAAGTTTAGGAACCCCACGGTGGCGCCCACGCACGATGTGACCACCGACCGCAGCCAGCGGCTGACGCT
GCGCTTCGTGCCCGTGGACCGCGAGGACAACACCTACTCGTACAAAGTGCGCTACACGCTGGCCGTGGGCGACAACCGCGTG
CTGGACATGGCCAGCACCTACTTTGACATCCGCGGCGTGCTGGATCGGGGCCCAGCTTCAAACCCTACTCCGGCACCGCCTA
CAACAGCCTGGCTCCCAAGGGAGCGCCCAACACTTGCCAGTGGACATATAAAGCTGGTGATACTGATACAGAAAAACCTATA
CATATGGAAATGCACCTGTGCAAGGCATTAGCATTACAAAGGATGGTATTCAACTTGGAACTGACAGCGATGGTCAGGCAATC
TATGCAGACGAAACTTATCAACCAGAGCCTCAAGTGGGTGATGCTGAATGGCATGACATCACTGGTACTGATGAAAAATATGG
AGGCAGAGCTCTTAAGCCTGACACCAAAATGAAGCCTTGCTATGGTTCTTTTGCCAAGCCTACCAATAAAGAAGGAGGCCAGG
CAAATGTGAAAACCGAAACAGGCGGTACCAAAGAATATGACATTGACATGGCATTCTTCGATAATCGAAGTGCAGCTGCCGCC
GGCCTAGCCCCAGAAATTGTTTTGTATACTGAGAATGTGGATCTGGAAACTCCAGATACCCATATTGTATACAAGGCAGGTAC
AGATGACAGTAGCTCTTCTATCAATTTGGGTCAGCAGTCCATGCCCAACAGACCCAACTACATTGGCTTCAGAGACAACTTTAT
CGGTCTGATGTACTACAACAGCACTGGCAATATGGGTGTACTGGCTGGACAGGCCTCCCAGCTGAATGCTGTGGTGGACTTGC
AGGACAGAAACACCGAACTGTCCTACCAGCTCTTGCTTGACTCTCTGGGTGACAGAACCAGGTATTTCAGTATGTGGAATCAG
GCGGTGGACAGTTATGACCCCGATGTGCGCATTATTGAAAATCACGGTGTGGAGGATGAACTTCCTAACTATTGCTTCCCCCTG
GATGCTGTGGGTAGAACTGATACTTACCAGGGAATTAAGGCCAATGGTGATAATCAAACCACCTGGACCAAAGATGATACTGT
TAATGATGCTAATGAATTGGGCAAGGGCAATCCTTTCGCCATGGAGATCAACATCCAGGCCAACCTGTGGCGGAACTTCCTCT
ACGCGAACGTGGCGCTGTACCTGCCCGACTCCTACAAGTACACGCCGGCCAACATCACGCTGCCCACCAACACCAACACCTAC
GATTACATGAACGGCCGCGTGGTGGCGCCCTCGCTGGTGGACGCCTACATCAACATCGGGGCGCGCTGGTCGCTGGACCCCA
TGGACAACGTCAACCCCTTCAACCACCACCGCAACGCGGGCCTGCGATACCGCTCCATGCTCCTGGGCAACGGGCGCTACGTG
CCCTTCCACATCCAGGTGCCCCAAAAGTTTTTCGCCATCAAGAGCCTCCTGCTCCTGCCCGGGTCCTACACCTACGAGTGGAACT
TCCGCAAGGACGTCAACATGATCCTGCAGAGCTCCCTCGGCAACGACCTGCGCACGGACGGGGCCTCCATCGCCTTCACCAGC
ATCAACCTCTACGCCACCTTCTTCCCCATGGCGCACAACACCGCCTCCACGCTCGAGGCCATGCTGCGCAACGACACCAACGAC
CAGTCCTTCAACGACTACCTCTCGGCGGCCAACATGCTCTACCCCATCCCGGCCAACGCCACCAACGTGCCCATCTCCATCCCCT
```

Fig. 23F

```
CGCGCAACTGGGCCGCCTTCCGCGGCTGGTCCTTCACGCGCCTCAAGACCCGCGAGACGCCCTCGCTCGGCTCCGGGTTCGAC
CCCTACTTCGTCTACTCGGGCTCCATCCCCTACCTCGACGGCACCTTCTACCTCAACCACACCTTCAAGAAGGTCTCCATCACCTT
CGACTCCTCCGTCAGCTGGCCCGGCAACGACCGCCTCCTGACGCCCAACGAGTTCGAAATCAAGCGCACCGTCGACGGAGAG
GGGTACAACGTGGCCCAGTGCAACATGACCAAGGACTGGTTCCTGGTCCAGATGCTGGCCCACTACAACATCGGCTACCAGG
GCTTCTACGTGCCCGAGGGCTACAAGGACCGCATGTACTCCTTCTTCCGCAACTTCCAGCCCATGAGCCGCCAGGTCGTGGAC
GAGGTCAACTACAAGGACTACCAGGCCGTCACCCTGGCCTACCAGCACAACAACTCGGGCTTCGTCGGCTACCTCGCGCCCAC
CATGCGCCAGGGCCAGCCCTACCCCGCCAACTACCCCTACCCGCTCATCGGCAAGAGCGCCGTCGCCAGCGTCACCCAGAAAA
AGTTCCTCTGCGACCGGGTCATGTGGCGCATCCCCTTCTCCAGCAACTTCATGTCCATGGGCGCGCTCACCGACCTCGGCCAGA
ACATGCTCTACGCCAACTCCGCCCACGCGCTAGACATGAATTTCGAAGTCGACCCCATGGATGAGTCCACCCTTCTCTATGTTGT
CTTCGAAGTCTTCGACGTCGTCCGAGTGCACCAGCCCCACCGCGGCGTCATCGAGGCCGTCTACCTGCGCACGCCCTTCTCGGC
CGGCAACGCCACCACCTAAGCCTCTTGCTTCTTGCAAGATGACGGCCTGCGCGGGCTCCGGCGAGCAGGAGCTCAGGGCCATC
CTCCGCGACCTGGGCTGCGGGCCCTGCTTCCTGGGCACCTTCGACAAGCGCTTCCCGGGATTCATGGCCCCGCACAAGCTGGC
CTGCGCCATCGTCAACACGGCCGGCCGCGAGACCGGGGGCGAGCACTGGCTGGCCTTCGCCTGGAACCCGCGCTCCCACACC
TGCTACCTCTTCGACCCCTTCGGGTTCTCGGACGAGCGCCTCAAGCAGATCTACCAGTTCGAGTACGAGGGCCTGCTGCGTCGC
AGCGCCCTGGCCACCGAGGACCGCTGCGTCACCCTGGAAAAGTCCACCCAGACCGTGCAGGGTCCGCGCTCGGCCGCCTGCG
GGCTCTTCTGCTGCATGTTCCTGCACGCCTTCGTGCACTGGCCCGACCGCCCCATGGACAAGAACCCCACCATGAACTTGCTGA
CGGGGGTGCCCAACGGCATGCTCCAGTCGCCCCAGGTGGAACCCACCCTGCGCCGCAACCAGGAGGCGCTCTACCGCTTCCTC
AACGCCCACTCCGCCTACTTTCGCTCCCACCGCGCGCGCATCGAGAAGGCCACCGCCTTCGACCGCATGAATCAAGACATGTAA
TCCGGTGTGTGTATGTGAATGCTTTATTCATCATAATAAACAGCACATGTTTATGCCACCTTCTCTGAGGCTCTGACTTTATTTA
GAAATCGAAGGGGTTCTGCCGGCTCTCGGCATGGCCCGCGGGCAGGGATACGTTGCGGAACTGGTACTTGGGCAGCCACTTG
AACTCGGGGATCAGCAGCTTCGGCACGGGGAGGTCGGGGAACGAGTCGCTCCACAGCTTGCGCGTGAGTTGCAGGGCGCCC
AGCAGGTCGGGCGCGGAGATCTTGAAATCGCAGTTGGGACCCGCGTTCTGCGCGCGAGAGTTACGGTACACGGGGTTGCAG
CACTGGAACACCATCAGGGCCGGGTGCTTCACGCTCGCCAGCACCGTCGCGTCGGTGATGCCCTCCACGTCCAGATCCTCGGC
GTTGGCCATCCCGAAGGGGGTCATCTTGCAGGTCTGCCGCCCCATGCTGGGCACGCAGCCGGGCTTGTGGTTGCAATCGCAGT
GCAGGGGGATCAGCATCATCTGGGCCTGCTCGGAGCTCATGCCCGGGTACATGGCCTTCATGAAAGCCTCCAGCTGGCGGAA
GGCCTGCTGCGCCTTGCCGCCCTCGGTGAAGAAGACCCCGCAGGACTTGCTAGAGAACTGGTTGGTGGCGCAGCCAGCGTCG
TGCACGCAGCAGCGCGCGTCGTTGTTGGCCAGCTGCACCACGCTGCGCCCCAGCGGTTCTGGGTGATCTTGGCCCGGTCGG
GGTTCTCCTTCAGCGCGCGCTGCCCGTTCTCGCTCGCCACATCCATCTCGATCGTGTGCTCCTTCTGGATCATCACGGTCCCGTG
CAGGCACCGCAGCTTGCCCTCGGCCTCGGTGCACCCGTGCAGCCACAGCGCGCAGCCGGTGCTCTCCCAGTTCTTGTGGGCGA
TCTGGGAGTGCGAGTGCACGAAGCCCTGCAGGAAGCGGCCCATCATCGTGGTCAGGGTCTTGTTGCTGGTGAAGGTCAGCGG
AATGCCGCGGTGCTCCTCGTTCACATACAGGTGGCAGATACGGCGGTACACCTCGCCCTGCTCGGGCATCAGCTGGAAGGCG
GACTTCAGGTCGCTCTCCACGCGGTACCGGTCCATCAGCAGCGTCATCACTTCCATGCCCTTCTCCCAGGCCGAAACGATCGGC
AGGCTCAGGGGGTTCTTCACCGTTGTCATCTTAGTCGCCGCCGCCGAAGTCAGGGGGTCGTTCTCGTCCAGGGTCTCAAACAC
TCGCTTGCCGTCCTTCTCGGTGATGCGCACGGGGGGAAAGCTGAAGCCCACGGCCGCCAGCTCCTCCTCGGCCTGCCTTTCGT
CCTCGCTGTCCTGGCTGATGTCTTGCAAAGGCACATGCTTGGTCTTGCGGGGTTTCTTTTTGGGCGGCAGAGGCGGCGGCGGA
GACGTGCTGGGCGAGCGCGAGTTCTCGCTCACCACGACTATTTCTTCTCCTTGGCCGTCGTCCGAGACCACGCGGCGGTAGGC
ATGCCTCTTCTGGGGCAGAGGCGGAGGCGACGGGCTCTCGCGGTTCGGCGGCGGCTGGCAGAGCCCCTTCCGCGTTCGGG
GGTGCGCTCCTGGCGGCGCTGCTCTGACTGACTTCCTCCGCGGCCGGCCATTGTGTTCTCCTAGGGAGCAAGCATGGAGACTC
AGCCATCGTCGCCAACATCGCCATCTGCCCCCGCCGCCGCCGACGAGAACCAGCAGCAGCAGAATGAAAGCTTAACCGCCCCG
CCGCCCAGCCCCACCTCCGACGCCGCAGCCCCAGACATGCAAGAGATGGAGGAATCCATCGAGATTGACCTGGGCTACGTGA
CGCCCGCGGAGCACGAGGAGGAGCTGGCAGCGCGCTTTTCAGCCCCGGAAGAGAACCACCAAGAGCAGCCAGAGCAGGAAG
CAGAGAGCGAGCAGAACCAGGCTGGGCTCGAGCATGGCGACTACCTGAGCGGGGCAGAGGACGTGCTCATCAAGCATCTGG
CCCGCCAATGCATCATCGTCAAGGACGCGCTGCTCGACCGCGCCGAGGTGCCCCTCAGCGTGGCGGAGCTCAGCCGCGCCTAC
GAGCGCAACCTCTTCTCGCCGCGCGTGCCCCCCAAGCGCCAGCCCAACGGCACCTGCGAGCCCAACCCGCGCCTCAACTTCTAC
CCGGTCTTCGCGGTGCCCGAGGCCCTGGCCACCTACCACCTCTTTTTCAAGAACCAAAGGATCCCCGTCTCCTGCCGCGCCAAC
CGCACCCGCGCCGACGCCCTGCTCAACCTGGGCCCCGGCGCCCGCCTACCTGATATCGCCTCCTTGGAAGAGGTTCCCAAGAT
CTTCGAGGGTCTGGGCAGCGACGAGACTCGGGCCGCGAACGCTCTGCAAGGAAGCGGAGAGGAGCATGAGCACCACAGCGC
CCTGGTGGAGTTGGAAGGCGACAACGCGCGCCTGGCGGTCCTCAAGCGCACGGTCGAGCTGACCCACTTCGCCTACCCGGCG
CTCAACCTGCCCCCCAAGGTCATGAGCGCCGTCATGGACCAGGTGCTCATCAAGCGCGCCTCGCCCCTCTCGGAGGAGGAGAT
GCAGGACCCCGAGAGCTCGGACGAGGGCAAGCCCGTGGTCAGCGACGAGCAGCTGGCGCGCTGGCTGGGAGCGAGTAGCA
CCCCCCAGAGCCTGGAAGAGCGGCGCAAGCTCATGATGGCCGTGGTCCTGGTGACCGTGGAGCTGGAGTGTCTGCGCCGCTT
```

Fig. 23G

```
CTTCGCCGACGCGGAGACCCTGCGCAAGGTCGAGGAGAACCTGCACTACCTCTTCAGACACGGGTTCGTGCGCCAGGCCTGC
AAGATCTCCAACGTGGAGCTGACCAACCTGGTCTCCTACATGGGCATCCTGCACGAGAACCGCCTGGGGCAGAACGTGCTGCA
CACCACCCTGCGCGGGGAGGCCCGCCGCGACTACATCCGCGACTGCGTCTACCTGTACCTCTGCCACACCTGGCAGACGGGCA
TGGGCGTGTGGCAGCAGTGCCTGGAGGAGCAGAACCTGAAAGAGCTCTGCAAGCTCCTGCAGAAGAACCTCAAGGCCCTGTG
GACCGGGTTCGACGAGCGCACCACCGCCGCGGACCTGGCCGACCTCATCTTCCCCGAGCGCCTGCGGCTGACGCTGCGCAAC
GGGCTGCCCGACTTTATGAGCCAAAGCATGTTGCAAAACTTTCGCTCTTTCATCCTCGAACGCTCCGGGATCCTGCCCGCCACC
TGCTCCGCGCTGCCCTCGGACTTCGTGCCGCTGACCTTCCGCGAGTGCCCCCCGCCGCTCTGGAGCCACTGCTACCTGCTGCGC
CTGGCCAACTACCTGGCCTACCACTCGGACGTGATCGAGGACGTCAGCGGCGAGGGCCTGCTCGAGTGCCACTGCCGCTGCA
ACCTCTGCACGCCGCACCGCTCCCTGGCCTGCAACCCCCAGCTGCTGAGCGAGACCCAGATCATCGGCACCTTCGAGTTGCAA
GGCCCCGGCGAGGGCAAGGGGGGTCTGAAACTCACCCCGGGGCTGTGGACCTCGGCCTACTTGCGCAAGTTCGTGCCCGAG
GACTACCATCCCTTCGAGATCAGGTTCTACGAGGACCAATCCCAGCCGCCCAAGGCCGAGCTGTCGGCCTGCGTCATCACCCA
GGGGGCCATCCTGGCCCAATTGCAAGCCATCCAGAAATCCCGCCAAGAATTTCTGCTGAAAAAGGGCCACGGGGTCTACTTGG
ACCCCCAGACCGGAGAGGAGCTCAACCCCAGCTTCCCCCAGGATGCCCCGAGGAAGCAGCAAGAAGCTGAAAGTGGAGCTGC
CGCCGCCGCCGGAGGATTTGGAGGAAGACTGGGAGAGCAGTCAGGCAGAGGAGGAGGAGATGGAAGACTGGGACAGCACT
CAGGCAGAGGAGGACAGCCTGCAAGACAGTCTGGAGGAGGAAGACGAGGTGGAGGAGGCAGAGGAAGAAGCAGCCGCCG
CCAGACCGTCGTCCTCGGCGGAGGAGGAGAAAGCAAGCAGCACGGATACCATCTCCGCTCCGGGTCGGGGTCGCGGCGGCC
GGGCCCACAGTAGATGGGACGAGACCGGGCGCTTCCCGAACCCCACCACCCAGACCGGTAAGAAGGAGCGGCAGGGATACA
AGTCCTGGCGGGGCACAAAAACGCCATCGTCTCCTGCTTGCAAGCCTGCGGGGGCAACATCTCCTTCACCCGGCGCTACCTG
CTCTTCCACCGCGGGGTGAACTTCCCCCGCAACATCTTGCATTACTACCGTCACCTCCACAGCCCCTACTACTGTTTCCAAGAAG
AGGCAGAAACCCAGCAGCAGCAGCAGCAGCAGAAAACCAGCGGCAGCAGCTAGAAAATCCACAGCGGCGGCAGGTGGACT
GAGGATCGCGGCGAACGAGCCGGCGCAGACCCGGGAGCTGAGGAACCGGATCTTTCCCACCCTCTATGCCATCTTCCAGCAG
AGTCGGGGGCAAGAGCAGGAACTGAAAGTCAAGAACCGTTCTCTGCGCTCGCTCACCCGCAGTTGTCTGTATCACAAGAGCG
AAGACCAACTTCAGCGCACTCTCGAGGACGCCGAGGCTCTCTTCAACAAGTACTGCGCGCTCACTCTTAAAGAGTAGCCCGCG
CCCGCCCACACACGGAAAAAGGCGGGAATTACGTCACCACCTGCGCCCTTCGCCCGACCATCATCATGAGCAAAGAGATTCCC
ACGCCTTACATGTGGAGCTACCAGCCCCAGATGGGCCTGGCCGCCGGCGCCGCCCAGGACTACTCCACCCGCATGAACTGGCT
CAGTGCCGGGCCCGCGATGATCTCACGGGTGAATGACATCCGCGCCCACCGAAACCAGATACTCCTAGAACAGTCAGCGATCA
CCGCCACGCCCCGCCATCACCTTAATCCGCGTAATTGGCCCGCCGCCCTGGTGTACCAGGAAATTCCCCAGCCCACGACCGTAC
TACTTCCGCGAGACGCCCAGGCCGAAGTCCAGCTGACTAACTCAGGTGTCCAGCTGGCCGGCGGCGCCGCCCTGTGTCGTCAC
CGCCCCGCTCAGGGTATAAAGCGGCTGGTGATCCGAGGCAGAGGCACACAGCTCAACGACGAGGTGGTGAGCTCTTCGCTGG
GTCTGCGACCTGACGGAGTCTTCCAACTCGCCGGATCGGGGAGATCTTCCTTCACGCCTCGTCAGGCCGTCCTGACTTTGGAG
AGTTCGTCCTCGCAGCCCCGCTCGGGTGGCATCGGCACTCTCCAGTTCGTGGAGGAGTTCACTCCCTCGGTCTACTTCAACCCC
TTCTCCGGCTCCCCCGGCCACTACCCGGACGAGTTCATCCCGAACTTCGACGCCATCAGCGAGTCGGTGGACGGCTACGATTG
AATGTCCCATGGTGGCGCGGCTGACCTAGCTCGGCTTCGACACCTGGACCACTGCCGCCGCTTCCGCTGCTTCGCTCGGGATCT
CGCCGAGTTTGCCTACTTTGAGCTGCCCGAGGAGCACCCTCAGGGCCCGGCCCACGAGTGCGGATCGTCGTCGAAGGGGGT
CTCGACTCCACCTGCTTCGGATCTTCAGCCAGCGTCCGATCCTGGCCGAGCGCGAGCAAGGACAGACCCTTCTGACCCTGTAC
TGCATCTGCAACCACCCCGGCCTGCATGAAAGTCTTTGTTGTCTGCTGTGTACTGAGTATAATAAAAGCTGAGATCAGCGACTA
CTCCGGACTTCCGTGTGTTCCTGCTATCAACCAGTCCCTGTTCTTCACCGGGAACGAGACCGAGCTCCAGCTCCAGTGTAAGCC
CCACAAGAAGTACCTCACCTGGCTGTTCCAGGGCTCTCCGATCGCCGTTGTCAACCACTGCGACAACGACGGAGTCCTGCTGA
GCGGCCCTGCCAACCTTACTTTTTCCACCCGCAGAAGCAAGCTCCAGCTCTTCCAACCCTTCCTCCCCGGGACCTATCAGTGCGT
CTCGGGACCCTGCCATCACACCTTCCACCTGATCCCGAATACCACAGCGTCGCTCCCCGCTACTAACAACCAAACTACCCACCAA
CGCCACCGTCGCGACCGCGGACATGTACAGAGCTCGAGAAGTACTAGGCCACAATACATGCCCATATTAGACTATGAGGCCGA
GCCACAGCGACCCATGCTCCCCGCTATTAGTTACTTCAATCTAACCGGCGGAGATGACTGACCCACTGGCCAACAACAACGTCA
ACGACCTTCTCCTGGACATGGACGGCCGCGCCTCGGAGCAGCGACTCGCCCAACTTCGCATTCGCCAGCAGCAGGAGAGAGC
CGTCAAGGAGCTGCAGGACGGCATAGCCATCCACCAGTGCAAGAAAGGCATCTTCTGCCTGGTGAAACAGGCCAAGATCTCC
TACGAGGTCACCCCGACCGACCATCGCCTCTCCTACGAGCTCCTGCAGCAGCGCCAGAAGTTCACCTGCCTGGTCGGAGTCAA
CCCCATCGTCATCACCCAGCAGTCGGGCGATACCAAGGGGTGCATCCACTGCTCCTGCGACTCCCCGACTGCGTCCACACTCT
GATCAAGACCCTCTGCGGCCTCCGCGACCTCCTCCCCATGAACTAATCACCCCCTTATCCAGTGAAATAAATATCATATTGATGA
TGATTTAAATAAAAAATAATCATTTGATTTGAAATAAAGATACAATCATATTGATGATTTGAGTTTTAAAAAATAAAGAATCACT
TACTTGAAATCTGATACCAGGTCTCTGTCCATGTTTTCTGCCAACACCACCTCACTCCCCTCTTCCCAGCTCTGGTACTGCAGACC
CCGGCGGGCTGCAAACTTCCTCCACACGCTGAAGGGGATGTCAAATTCCTCCTGTCCCTCAATCTTCATTTTATCTTCTATCAGA
TGTCCAAAAAGCGCGTCCGGGTGGATGATGACTTCGACCCCGTCTACCCCTACGATGCAGACAACGCACCGACCGTGCCCTTC
```

Fig. 23H

```
ATCAACCCCCCCTTCGTCTCTTCAGATGGATTCCAAGAGAAGCCCCTGGGGGTGCTGTCCCTGCGACTGGCTGACCCCGTCACC
ACCAAGAACGGGGAAATCACCCTCAAGCTGGGAGAGGGGGTGGACCTCGACTCCTCGGGAAAACTCATCTCCAACACGGCCA
CCAAGGCCGCCGCCCCTCTCAGTTTTTCCAACAACACCATTTCCCTTAACATGGATACCCCTCTTTATACCAAAGATGGAAAATT
ATCCTTACAAGTTTCTCCACCGTTAAACATATTAAAATCAACCATTCTGAACACATTAGCTGTAGCTTATGGATCAGGTTTAGGA
CTGAGTGGTGGCACTGCTCTTGCAGTACAGTTGGCCTCTCCACTCACTTTTGATGAAAAAGGAAATATTAAAATTAACCTAGCC
AGTGGTCCATTAACAGTTGATGCAAGTCGACTTAGTATCAACTGCAAAAGAGGGGTCACTGTCACTACCTCAGGAGATGCAAT
TGAAAGCAACATAAGCTGGCCTAAAGGTATAAGATTTGAAGGTAATGGCATAGCTGCAAACATTGGCAGAGGATTGGAATTT
GGAACCACTAGTACAGAGACTGATGTCACAGATGCATACCCAATTCAAGTTAAATTGGGTACTGGCCTTACCTTTGACAGTACA
GGCGCCATTGTTGCTTGGAACAAAGAGGATGATAAACTTACATTATGGACCACAGCCGACCCCTCGCCAAATTGCAAAATATA
CTCTGAAAAGATGCCAAACTCACACTTTGCTTGACAAAGTGTGGAAGTCAAATTCTGGGTACTGTGACTGTATTGGCAGTGA
ATAATGGAAGTCTCAACCCAATCACAAACACAGTAAGCACTGCACTCGTCTCCCTCAAGTTTGATGCAAGTGGAGTTTTGCTAA
GCAGCTCCACATTAGACAAAGAATATTGGAACTTCAGAAAGGGAGATGTTACACCTGCTGAGCCCTATACTAATGCTATAGGT
TTTATGCCTAACATAAAGGCCTATCCTAAAAACACATCTGCAGCTTCAAAAAGCCATATTGTCAGTCAAGTTTATCTCAATGGG
GATGAGGCCAAACCACTGATGCTGATTATTACTTTTAATGAAACTGAGGATGCAACTTGCACCTACAGTATCACTTTTCAATGG
AAATGGGATAGTACTAAGTACACAGGTGAAACACTTGCTACCAGCTCCTTCACCTTCTCCTACATCGCCCAAGAATGAACACTG
TATCCCACCCTGCATGCCAACCCTTCCCACCCCACTCTGTCTATGGAAAAAACTCTGAAGCACAAAATAAAATAAAGTTCAAGT
GTTTTATTGATTCAACAGTTTTACAGGATTCGAGCAGTTATTTTTCCTCCACCCTCCCAGGACATGGAATACACCACCCTCTCCCC
CCGCACAGCCTTGAACATCTGAATGCCATTGGTGATGGACATGCTTTTGGTCTCCACGTTCCACACAGTTTCAGAGCGAGCCAG
TCTCGGGTCGGTCAGGGAGATGAAACCCTCCGGGCACTCCCGCATCTGCACCTCACAGCTCAACAGCTGAGGATTGTCCTCGG
TGGTCGGGATCACGGTTATCTGGAAGAAGCAGAAGAGCGGCGGTGGGAATCATAGTCCGCGAACGGGATCGGCCGGTGGTG
TCGCATCAGGCCCCGCAGCAGTCGCTGCCGCCGCCGCTCCGTCAAGCTGCTGCTCAGGGGGTCCGGGTCCAGGGACTCCCTCA
GCATGATGCCCACGGCCCTCAGCATCAGTCGTCTGGTGCGGCGGGCGCAGCAGCGCATGCGGATCTCGCTCAGGTCGCTGCA
GTACGTGCAACACAGGACCACCAGGTTGTTCAACAGTCCATAGTTCAACACGCTCCAGCCGAAACTCATCGCGGGAAGGATGC
TACCCACGTGGCCGTCGTACCAGATCCTCAGGTAAATCAAGTGGCGCTCCCTCCAGAACACGCTGCCCACGTACATGATCTCCT
TGGGCATGTGGCGGTTCACCACCTCCCGGTACCACATCACCCTCTGGTTGAACATGCAGCCCCGGATGATCCTGCGGAACCAC
AGGGCCAGCACCGCCCCGCCCGCCATGCAGCGAAGAGACCCCGGGTCCCGGCAATGGCAATGGAGGACCCACCGCTCGTACC
CGTGGATCATCTGGGAGCTGAACAAGTCTATGTTGGCACAGCACAGGCATATGCTCATGCATCTCTTCAGCACTCTCAGCTCCT
CGGGGGTCAAAACCATATCCCAGGGCACGGGGAACTCTTGCAGGACAGCGAACCCCGCAGAACAGGGCAATCCTCGCACATA
ACTTACATTGTGCATGGACAGGGTATCGCAATCAGGCAGCACGGGTGATCCTCCACCAGAGAAGCGCGGGTCTCGGTCTCCT
CACAGCGTGGTAAGGGGGCCGGCCGATACGGGTGATGGCGGGACGCGGCTGATCGTGTTCGCGACCGTGTCATGATGCAGT
TGCTTTCGGACATTTTCGTACTTGCTGTAGCAGAACCTGGTCCGGGCGCTGCACACCGATCGCCGGCGGCGGTCCCGGCGCTT
GGAACGCTCGGTGTTGAAATTGTAAAACAGCCACTCTCTCAGACCGTGCAGCAGATCTAGGGCCTCAGGAGTGATGAAGATCC
CATCATGCCTGATAGCTCTGATCACATCGACCACCGTGGAATGGGCCAGACCCAGCCAGATGATGCAATTTTGTTGGGTTTCG
GTGACGGCGGGGAGGGAAGAACAGGAAGAACCATGATTAACTTTTAATCCAAACGGTCTCGGAGCACTTCAAAATGAAGGT
CGCGGAGATGGCACCTCTCGCCCCCGCTGTGTTGGTGGAAAATAACAGCCAGGTCAAAGGTGATACGGTTCTCGAGATGTTCC
ACGGTGGCTTCCAGCAAAGCCTCCACGCGCACATCCAGAAACAAGACAATAGCGAAAGCGGGAGGGTTCTCTAATTCCTCAAT
CATCATGTTACACTCCTGCACCATCCCCAGATAATTTTCATTTTTCCAGCCTTGAATGATTCGAACTAGTTCCTGAGGTAAATCCA
AGCCAGCCATGATAAAGAGCTCGCGCAGAGCGCCCTCCACCGGCATTCTTAAGCACACCCTCATAATTCCAAGATATTCTGCTC
CTGGTTCACCTGCAGCAGATTGACAAGCGGAATATCAAAATCTCTGCCGCGATCCCTAAGCTCCTCCCTCAGCAATAACTGTAA
GTACTCTTTCATATCCTCTCCGAAATTTTTAGCCATAGGACCACCAGGAATAAGATTAGGGCAAGCCACAGTACAGATAAACCG
AAGTCCTCCCCAGTGAGCATTGCCAAATGCAAGACTGCTATAAGCATGCTGGCTAGACCCGGTGATATCTTCCAGATAACTGG
ACAGAAAATCACCCAGGCAATTTTTAAGAAAATCAACAAAAGAAAAATCCTCCAGGTGCACGTTTAGAGCCTCGGGAACAACG
ATGAAGTAAATGCAAGCGGTGCGTTCCAGCATGGTTAGTTAGCTGATCTGTAAAAAACAAAAAATAAAACATTAAACCATGCT
AGCCTGGCGAACAGGTGGGTAAATCGTTCTCTCCAGCACCAGGCAGGCCACGGGGTCTCCGGCGCGACCCTCGTAAAAATTG
TCGCTATGATTGAAAACCATCACAGAGAGACGTTCCCGGTGGCCGGCGTGAATGATTCGACAAGATGAATACACCCCCGGAAC
ATTGGCGTCCGCGAGTGAAAAAAGCGCCCGAGGAAGCAATAAGGCACTACAATGCTCAGTCTCAAGTCCAGCAAAGCGATG
CCATGCGGATGAAGCACAAAATCCTCAGGTGCGTACAAAATGTAATTACTCCCCTCCTGCACAGGCAGCGAAGCCCCGATCC
CTCCAGATACACATACAAAGCCTCAGCGTCCATAGCTTACCGAGCAGCAGCACACAACAGGCGCAAGAGTCAGAGAAGGCT
GAGCTCTAACCTGTCCACCCGCTCTCTGCTCAATATATAGCCCAGATCTACACTGACGTAAAGGCCAAAGTCTAAAAATACCCG
CCAAATAATCACACACGCCCAGCACACGCCCAGAAACCGGTGACACACTCAAAAAAATACGCGCACTTCCTCAAACGCCCAAA
CTGCCGTCATTTCCGGGTTCCCACGCTACGTCATCGGAATTCGACTTTCAAATTCCGTCGACCGTTAAAAACGTCACCCGCCCCG
CCCCTAACGGTCGCCCGTCTCTCGGCCAATCACCTTCCTCCCTCCCCAAATTCAAACAGCTCATTTGCATATTAACGCGCACCAA
AAGTTTGAGGTATATTATTGATGATG
```

Fig. 231

AdC7 010-HIVgag(E1048)  Amino acids – SEQ ID NO: 12
The symbol " * " refers herein to stop codons in the non coding regions HHQ*YTSNFWCALICK*AV*IWGGRKVIGRETGDR*GRGG*RFDDVAVRRSRFASSRGKSDVKRGVV*TRKYSIFPRSLTGNEVFLG
GCK*KRAIFARKLNEEVKI*VISRLWQGGVFAEGRVDFDRLRGGFDYRIFHLNFRVRCQSPVFLRTISFPRKCHLTVTITVLR*RKLRSP
DPLWCTLSTICSDAA*LSQYLLPACVLEVAE*CASKI*ATTRQGLTDNCMKNLLRVRRFALLRDVRARYTR*H*LLTSY***SITGSLVH
SPYMEFRVT*LTVNGPPG*PPNDPRPLTSIMTYVPIVTPIGTFH*RQWVEYLR*TAHLAVHQVYHMPSTPPIDVNDGKWPAWHYA
QYMTLWDFPTWQYIYVLVIAITMVMRFWQYINGRG*RFDSRGFPSLHPIDVNGSLFWHQNQRDFPKCRNNSAPLTQMGGRRVR
WEVYISRARLVNRQITRSFIAVVYHS*IANAVSASDTTVSNLSCRSWS*GTGQVSIKVTRQV*GDQ*KLGLSRQRRLLRF**APIGLTD
IHFAFLSTGVHSQFNYSS*G*ST*YDSL*ASATMGARASVLSGGELDRWEKIRLRPGGKKKYKLKHIVWASRELERFAVNPGLLETSE
GCRQILGQLQPSLQTGSEELRSLYNTVATLYCVHQRIEVKDTKEALEKIEEEQNKSKKKAQQAAADTGNSSQVSQNYPIVQNLQGQ
MVHQAISPRTLNAWVKVVEEKAFSPEVIPMFSALSEGATPQDLNTMLNTVGGHQAAMQMLKETINEEAAEWDRLHPVHAGPIA
PGQMREPRGSDIAGTTSTLQEQIGWMTNNPPIPVGEIYKRWIILGLNKIVRMYSPTSILDIRQGPKEPFRDYVDRFYKTLRAEQASQE
VKNWMTETLLVQNANPDCKTILKALGPAATLEEMMTACQGVGGPGHKARVLAEAMSQVTNSATIMMQRGNFRNQRKTVKCFN
CGKEGHIAKNCRAPRKKGCWKCGKEGHQMKDCTERQANFLGKIWPSHKGRPGNFLQSRPEPTAPPEESFRFGEETTTPSQKQEPI
DKELYPLASLRSLFGNDPSSQ**SSV*TGPLESTRAAKPLISLDCAF*LPAICCLPLPRAFLDPGRCHSHCPFLIK*GNCIALSE*VSFYSG
GWGGAGQQGGGLGRQ*QACWGCGGLYGF*GGKNQQICRSEFIYVGCGERGNEMALWVLWVCINESARYAGHRACDLAPPQD
MARVRAQRHDPMQCAPGVPPRHVHALPVQHAICEGAAGARCHVQSEPDGGV*HECGAVENSEI**IQDQVPGLRMRRQARQA
SARVCGGDGGPATRSFGVVLQRDGVRLQRGRI*LE*VVFGGGGGLV*GAE*LKSVFFCVLQQHERKRLL*GRGIQPLSDGASPLLG
GSASECDGIHGGRPARAARELFNPDLRDPELLVRGRSCRRSCCFRRQRRARNGPGRRLLQLSGGQLDFHQ*SRQPERGEAAAADG
PARGPDPAPGRADPAGGSAAGGDAGRGCHGENQIKNESINKRRRLLILTQSLESLFDFSRAVGPGPPVSIIEHPVDFFQDPVEVGLD
VEVHGHEPVPGVEVAPLQGLVLGGGVVNHPVIAGAQGVVLHDVLEEETDGHGQPLGVGVDEPVELGGMHAGGDEMHLGLDLEI
GDVPAQIPPGVHVVQDHQHGVSGALGEFVMQLGREGVKEFGDALVTAQVFHALIHDDGDGPVGGGLGKDVSGVGHIVVVVLGE
LVIGHFNEFGAEGARLGDEGALDPGGVVALADLHLPGLELGGGDHVHLRGDEKNGFRGGGDELGRKQVPEQLGLAAAGGAVDDP
DDRLQVVVEGETAAVLAEEGGHLVHHLAHMHVLAHEFRQEALAPQREELLQRGEVFQRLEPVGHGHFGEGLLQEFQTVPELGDVL
*GISIQQTSSFRGLGRLRE*GTRRWASSEARVRSFQGRRVRVSVVSVTVKGCAPGWALARVRFRLIRLVENRSRSAPCASAR*QLSM
SS*LSASAAWPLARSLPLEVCPQTGQRRDLRA*SLGARKTDSGA*ASAPQLAQTVSHSTSQVRSGRLGSKTRFPPCFLMRFLPLVSM
SSCPRWVTKRLSVSP*TDFMGRSSSGVPRSSS*RNPAHSETKARVQASTKEATWEG*RSLSTSGSTFSRVCKHMSPSSTSRKVIGL*V
*AT*PGVPAGGV*KGAGPCSSSLSSGSLSRSASCWGRYSLSKAGITSALRLSVSRNEEDLILTVPLETPFMSPSSIWSEKTIFLLSSLVAK
EP*RALERSLAMERMVWFFSLSARSLAAMLSCTYSRATHFHSGKTVVSSSGTILTRQPRLCRVMRSTLVATSPRRGSLVQQRRPPLR
EQKGGSGSSMSSSGGSASTVKMPGRSSGSK*LMQVSRSSSAACQSRTASARS*GLRGVPQGMGCVSAEAYMPQMS*T*RGSSRT
PM*VG*QRPPRMLART*SYSSCEGARSPVPRLERCGFSAR*TIWRKMAWELEEMVGLWKMLKWAWGRPTESLMKWA*ESCSL
ATSSAVTRTSRAQ*SRVSWMMSYLSWPFCFHSSRLRRNSSRSFQYSSRGNPS*SAR*EPTM*NWLTAL*AQQPFSTGRA*ACAAL
RREVMWVRAKVSRTMTLRNWCLKSRSSQPPCSQSWKSVRFL*AGLGKAKVTSLKRILPARGMKLRVMRKGWGTSARLLMTWAAR
TISSKPLMLCPTM*SSTNRGRPLTWGSFLSSS*VSSAGSLSPCCSRAQSATWGLALRKEVQRSTARAVCKRSRY*RNCWPTAIFSGVT
Q*KVRGSPCQRSHLSWRARSWASSTSGGSPESFMTSMKGTSCLPKDPIQV*VSTS*VRKSLSVRGCEPMGKNWISCHQLEEWLLM
*WK*KCRRRAEHSCLCLYKRPQCSQRCTGCTCCTSCTWVPLTRNFSGQWSAGGCIWCCTTSWPSAWPSSASMVVMLTSPRGRQ
VQTSARTGRRARTRARRPELSRVLRRCGVRSVGSGGARLTCRSFSRARGRSRWYLISTAPLVATSTACRVPCPWGATTVPRFFLGAA
SMPVRSGGEDARRAAGAARDPEAGAAGARRRRARAGSGTAPGEDWRERRRDG*RPGSDASG*RPRDP*V*T*KRVRQNQSRYR
*RRPAAGSLARRPSCPGRRSRS*TARSPPPEGLRGRRARRWPRGRWRCGP*AARRRSCRPSRRGCRPRLRRGRARA*PPGRG*A
RRGA*RPRSCRGAGRGS*AWWRCAR*RRST*SSGGAASR*RRPGLPSAPWPRRSPRRS*KTGSCAPRRSTPPPEDG*AQRWWRA
PRARRPRGAPLLPSLPPPLTSLLLPPQEAAAGEGPCVAGGARADGR*SARWSPRAGDAWSR*RRARPRGAAA*RRRRASPGGRRG
GLRWAGRGR*RCILSIGP*GLRART*ASRDPRDPKTAERRLRASRSRKVG*ARFLVLRGFREAGGRCCW**S*SRRS*DGGWWRG
APGPWARLAGCADGRPCPRRGPDTWRGPCSSPA*AAPRAPPPRPRGRACA*ARTRAGAGRAPGRRRRARRGWPAVSG*GWSG
SRRSRRSGGRLRC*WYRSSWP*RTS*RSGGRVARARGT*GASRRACRRCSRCRCARGTGIRRGSAAAAGGRAAIARWRGRRARGP
RA*GGGSRRCTWTSR*CRRRWWRRAGTRGRGSRCCAAAGSSSWWPRSGP*GARSRGCSRHTGKNESGQRLDSVAWRLSERVG
LRVYPGSNLESGWSRS*RGTGTPVSTQAC*RNLQDTEAGRFLALVAGHEKLVSAESDRPRWLAAVVWRKNRQGCVAVCPGSSLSA
RRRPDSAANVGVAAPSFPRPLSQPTSPVTERAPLFLVFLPDASRTAADAPPPSTSTAPTAAAAATAGASAPAPAAASHYRGGRRERS
RRSV*PGLGRGRGAGAAGGVVAGAAPARADEKGRSRGLRAQAEPVQRQERRGARGDARLPLPRGAGAAARPGPKAGAEGRGFR
GGRADGDQPRARARGRGQPGHGVRADREGGEQLPKILQQPRAHADRARGGDPGPDAPVGPAGGHRAEPHEQAADGAAVSGG
AAQSGQRDVQGGAAEYHRARGPLAPGPGEHSAEHRGAGARAAAVREAGGYQLLGAEPGQVLR*EDLQDPVRAHRQGGEDRRV

Fig. 23J

```
LHAHDPESADPERRSGGVPQRQDAPRGERQPPARAERPGADAQPAAGPDRGRDRGGELL*HGRGPALAAQPPGLGSCRRFPLRG
GGGR*GGGGRVPGRLMARPYFC*MQQQPPPPDPAMRAALQSQPSGINSSDDWTQAMQRIMALTTRNPEAFRQQPQANRLSA
ILEAVVPSRSNPTHEKVLAIVNALVENKAIRGDEAGLVYNALLERVARYNSTNVQTNLDRMVTDVREAVSQRERFHRESNLGSMVAL
NAFLSTQPANVPRGQEDYTNFISALRLMVAEVPQSEVYQSGPDYFFQTSRQGLQTVNLSQAFKNLQGLWGVQAPVGDRATVSSLL
TPNSRLLLLLVAPFTDSGSVSRDSYLGYLLNLYREAIGQAHVDEQTYQEITHVSRALGQEDPGNLEATLNFLLTNRSQKIPPQYALSTEE
ERILRYVQQSVGLFLMQEGATPSAALDMTARNMEPSMYARNRPFINKLMDYLHRAAAMNSDYFTNAILNPHWLPPPGFYTGEYD
MPDPNDGFLWDDVDSSVFSPRPATTVWKKEGGDRRPSSALSGRAGAAAAVPEAASPFPSLPFSLNSVRSSELGRLTRPRLLGEEEYL
NDSLLRPEREKNFPNNGIESLVDKMSRWKTYAHEHRDEPRASSSAGTRRRQRHDRQRGLVWDDEDSADDSSVLDLGGSGGGNPF
AHLRPRIGRLM*ESEKIKNGTHQGHGDQRAFFSVVCSSMMRRVYPEGPPPSYESVMQQAVAAAMQPPLEAPYVPPRYLAPTEGR
NSIRYSELAPLYDTTRLYLVDNKSADIASLNYQNDHSNFLTTVVQNNDFTPTEASTQTINFDERSRWGGQLKTIMHTNMPNVNEFM
YSNKFKARVMVSRKTPNGVAVDENYDGSQDELTYEWVEFELPEGNFSVTMTIDLMNNAIIDNYLAVGRQNGVLESDIGVKFDTRN
FRLGWDPVTELVMPGVYTNEAFHPDIVLLPGCGVDFTESRLSNLLGIRKRQPFQEGFQILYEDLEGGNIPALLDVEAYEKSKEEAAAA
ATAAVATASTEVRGDNFASAAAVAEAAETESKIVIQPVEKDSKDRSYNVLADKKNTAYRSWYLAYNYGDPEKGVRSWTLLTTSDVTC
GVEQVYWSLPDMMQDPVTFRSTRQVSNYPVVGAELLPVYSKSFFNEQAVYSQQLRAFTSLTHVFNRFPENQILVRPPAPTITTVSE
NVPALTDHGTLPLRSSIRGVQRVTVTDARRRTCPYVYKALGVVAPRVLSSRTF*KMSILISPSNNTGWGLRAPSKMYGGARQRSTQH
PVRVRGHFRAPWGALKGRVRSRTTVDDVIDQVVADARNYTPAAAPASTVDAVIDSVVADARRYARAKSRRRRIARRHRSTPAMRA
ARALLRRARRTGRRAMLRAARRAASGSSSAGRTRRRAATAAAAAIASMSRPRRGNVYWVRDAATGVRVPVRTPPRT*RC*LRDV
DVSQRRGGCPSANTRKRCSRSSRLRSTAPR*RRKESPAN*SGSKRTKRRRKMWTDWWSLCASSPPGGACSGAGGK*NRCCGPAP
RWSSRPASVPAPPPSAPTTRCTGTRTSSSRRSSVWASLLTASAAAPRP*KRRRCPSRWTTATPRRA*SR*PCSRCCRARRRAGASSA
RAARICTRPCS*WCPSARSWRTCWST*RWTPRCSPRSRCGPSSRWPRAWACRPWTSRSPRSPWKRRPSP*SPAPAPWRCRRIPG
CRRRLPPLAEDASTARPAC*CPTTRCILPSSPRRATAARASTAATPAAAARPPPAAAVVAPAAAAPRLPPPPWCGECTAAGASL*PC
RARATTRASPFNSAVASYLQIWPSHAASASPLRATEEESRAVEG*RGTGCVAITTGGGAPSASGWGEASCPR*SPSSPRRSGRSPA*
LPWRCRPLSATETQLGKFVIKKWTDAPGPVMCVFRWKTSIFRPWHRDTARGRLWAPGATSATAN*TGAPSIGAVSGAGLRISGPR
SKPMATRRGTAAQGRR*GKS*KSRTSSRRWSMAWPRASTGWWTWPTRPCRNRSTAAWTRSRPRGPWRCPRWRRSCLPWTSA
ATSDRVPTRRRRC*RTRTSRPRTRRR*NWVCPPRGPWRLWPPGC*NPAAAASPRPWTCLRLLPAPPQWLSPCRRWPSRRAPPEA
APRRTGRAL*TASWVWECRV*SAAAAIKRHCSA*LACLCVYVCPPTRRRKRRVAELQDGHPIDAAPVGVHAHRRTGRFGVPESGS
GAVRPRHRHLLQSGEQV*EPHGGAHARCDHRPQPAADAALRARGPRGQHLLVQSALHAGRGRQPRAGHGQHLL*HPRRAGSG
AQLQTLLRHRLQQPGSQGSAQHLPVDI*SW*Y*YRKNLYIWKCTCARH*HYKGWYSTWN*QRWSGNLCRRNLSTRASSG*C*M
A*HHWY**KIWRQSS*A*HQNEALLWFFCQAYQ*RRRPGKCENRNRRYQRI*H*HGILR*SKCSCRRPSPRNCFVY*ECGSGNSRY
PYCIQGRYR*Q*LFYQFGSAVHAQQTQLHWLQRQLYRSDVLQQHWQYGCTGWTGLPAECCGGLAGQKHRTVLPALA*LSG*QN
QVFQYVESGGGQL*PRCAHY*KSRCGG*TS*LLLPPGCCG*N*YLPGN*GQW**SNHLDQR*YCCIGQGQSFRHGDQHPG
QPVAELPLRERGAVPARLLQVHAGQHHAAHQHQHLRLHERPRGGALAGGRLHQHRGALVAGPHGQRQPLQPPPQRGPAIPLHA
PGQRALRALPHPGAPKVFRHQEPPAPARVLHLRVELPQGRQHDPAELPRQRPAHGRGLHRLHQHQPLRHLLPHGAQHRLHARGH
AAQRHQRPVLQRLPLGGQHALPHPGQRHQRAHLHPLAQLGRLPRLVLHAPQDPRDALARLRVRPLLRLLGLHPLRRHLLPQPHL
QEGLHHLRLLRQLARQRPPPDAQRVRNQAHRRRGVQRGPVQHDQGLVPGPDAGPLQHRLPGLLRARGLQGPHVLLPQLPAH
EPPGRGRGQLQGLPGRHPGLPAQQLGLRRLPRAHHAPGPALPRQLPLPAHRQERRRQRHPEKVPLRPGHVAHPLLQQLHVHGRA
HRPRPEHALRQLRPRARHEFRSRPHG*VHPSLCCLRSLRRRPSAPAPPRRHRGRLPAHALLGRQRHHLSLLLLAR*RPARAPASRSSG
PSSATWAAGPASWAPSTSASRDSWPRTSWPAPSSTRAARPGASTGWPSPGTRAPTPATSSTPSGSRTSASSRSTSSSTRACCVAA
PWPPRTAASPWKSPPRPCRVRARPPAGSSAACSCTPSCTGPTAPWTRTPP*TC*RGCPTACSSRPRWNPPCAATRRRSTASSTPTP
PTFAPTARASRRPPPSTA*IKTCNPVCVCECFIHHNKQHMFMPPSLRL*LYLEIEGVLPALGMARGQGYVAELVLGQPLELGDQQLR
HGEVGERVAPQLARELQGAQQVGRGDLEIAVGTRVLRARVTVHGVAALEHHQGRVLHARQHRRVGDALHVQILGVGHPEGGHL
AGLPPHAGHAAGLVVAIAVQGDQHHLGLLGAHARVHGLHESLQLAEGLLRLAALGEEDPAGLARELVGGAASVVHAAARVVVGQ
LHHAAPPAVLGDLGPVGVLLQRALPVLARHIHLDRVLLLDHHGPVQAPQLALGLGAPVQPQRAAGALPVLVGDLGVRVHEALQEA
AHHRGQGLVAGEGQRNAAVLLVHIQVADTAVHLALLGHQLEGGLQVALHAVPVHQQRHHFHALLPGRNDRQAQGVLHRCHLSR
RRRSQGVVLVQGLKHSLAVLLGDAHGGKAEAHGRQLLLGLPFVLAVLADVLQRHMLGLAGFLFGRQRRRRRAGRARVLAHHDYF
FSLAVVRDHAAVGMPLLGQRRRRRALAVRRAAGRAPSAFGGALLAALL*LTSSAAGHCVLLGSKHGDSAIVANIAICPRRRRREPAA
AE*KLNRPAAQPHLRRRSPRHARDGGIHRD*PGLRDARGARGGAGSALFSPGREPPRAARAGSRERAEPGWARAWRLPERGRGR
AHQASGPPMHHRQGRAARPRRGAPQRGGAQPRLRAQPLLAARAPQAPAQRHLRAQPAPQLLPGLRGARGPGHLPPLFQEPKDP
RLLPRQPHPRRRPAQPGPRRPPT*YRLLGRGSQDLRGSGQRRDSGRERSARKRRGA*APQRPGGVGRRQRAPGGPQAHGRADPL
RLPGAQPAPQGHERRHGPGAHQARLAPLGGGDAGPRELGRGQARGQRRAAGALAGSE*HPPEPGRAAQAHDGRGPGDRGAG
VSAPLLRRRGDPAQGRGEPALPLQTRVRAPGLQDLQRGADQPGLLHGHPAREPPGAERAAHHPARGGPPRLHPRLRLPVPLPHLA
```

Fig. 23K

DGHGRVAAVPGGAEPERALQAPAEEPQGPVDRVRRAHHRRGPGRPHLPRAPAADAAQRAARLYEPKHVAKLSLFHPRTLRDPAR
HLLRAALGLRAADLPRVPPAALEPLLPAAPGQLPGLPLGRDRGRQRRGPARVPLPLQPLHAAPLPGLQPPAAERDPDHRHLRVARP
RRGQGGSETHPGAVDLGLLAQVRARGLPSLRDQVLRGPIPAAQGRAVGLRHHPGGHPGPIASHPEIPPRISAEKGPRGLLGPPDRR
GAQPQLPPGCPEEAARS*KWSCRRRRIWRKTGRAVRQRRRRWKTGTALRQRRTACKTVWRRKTRWRRQRKKQPPPDRRPRRR
RRKQAARIPSPLRVGVAAAGPTVDGTRPGASRTPPPRPVRRSGRDTSPGGGTKTPSSPACKPAGATSPSPGATCSSTAG*TSPATSCI
TTVTSTAPTTVSKKRQKPSSSSSSRKPAAAARKSTAAAGGLRIAANEPAQTRELRNRIFPTLYAIFQQSRGQEQELKVKNRSLRSLTRSC
LYHKSEDQLQRTLEDAEALFNKYCALTLKE*PAPAHTRKKAGITSPPAPFARPSS*AKRFPRLTCGATSPRWAWPPAPPRTTPPA*TG
SVPGPR*SHG*MTSAPTETRYS*NSQRSPPRPAITLIRVIGPPPWCTRKFPSPRPYYFRETPRPKSS*LTQVSSWPAAPPCVVTAPLRV
*SGW*SEAEAHSSTTRW*ALRWVCDLTESSNSPDRGDLPSRLVRPS*LWRVRPRSPARVASALSSSWRSSLPRSTSTPSPAPPATTR
TSSSRTSTPSASRWTATIECPMVARLT*LGFDTWTTAAASAASLGISPSLPTLSCPRSTLRARPTECGSSSKGVSTPTCFGSSASVRSWP
SASKDRPF*PCTASATTPACMKVFVVCCVLSIIKAEISDYSGLPCVPAINQSLFFTGNETELQLQCKPHKKYLTWLFQGSPIAVVNHCD
NDGVLLSGPANLTFSTRRSKLQLFQPFLPGTYQCVSGPCHHTFHLIPNTTASLPATNNQTTHQRHRRDRGHVQSSRSTRPQYMPILD
YEAEPQRPMLPAISYFNLTGGDD*PTGQQQRQRPSPGHGRPRLGAATRPTSHSPAAGESRQGAAGRHSHPPVQERHLLPGETGQ
DLLRGHPDRPSPLLRAPAAAPEVHLPGRSQPHRHHPAVGRYQGVHPLLLRLPRLRPHSDQDPLRPPRPPPHELITPLSSEINIILMMI*
IKNNHLI*NKDTIILMI*VLKNKESLT*NLIPGLCPCFLPTPPHSPLPSSGTADPGGLQTSSTR*RGCQIPPVPQSSFYLLSDVQKARPGG
**LRPRLPLRCRQRTDRALHQPPLRLFRWIPREAPGGAVPATG*PRHHQERGNHPQAGRGGGPRLLGKTHLQHGHQGRRPSQFF
QQHHFP*HGYPSLYQRWKIILTSFSTVKHIKINHSEHISCSLWIRFRTEWWHCSCSTVGLSTHF**KRKY*N*PSQWSINS*CKST*YQ
LQKRGHCHYLRRCN*KQHKLA*RYKI*R*WHSCKHWQRIGIWNH*YRD*CHRCIPNSS*IGYWPYL*QYRRHCCLEQRG**TYIMD
HSRPLAKLQNIL*KRCQTHTLLDKVWKSNSGYCDCIGSE*WKSQPNHKHSKHCTRLPQV*CKWSFAKQLHIRQRILELQKGRCYTC*
ALY*CYRFYA*HKGLS*KHICSFKKPYCQSSLSQWG*GQTTDADYYF**N*GCNLHLQYHFSMEMG*Y*VHR*NTCYQLLHLLLHRP
RMNTVSHPACQPFPPHSVYGKNSEAQNKIKFKCFIDSTVLQDSSSYFSSTLPGHGIHHPLPPHSLEHLNAIGDGHAFGLHVPHSFRAS
QSRVGQGDETLRALPHLHLTAQQLRIVLGGRDHGYLEEAEERRWES*SANGIGRWCRIRPRSSRCRRRSVKLLLRGSGSRDSLSMM
PTALSISRLVRRAQQRMRISLRSLQYVQHRTTRLFNSP*FNTLQPKLIAGRMLPTWPSYQILR*IKWRSLQNTLPTYMISLGMWRFTT
SRYHITLWLNMQPRMILRNHRASTAPPAMQRRDPGSRQWQWRTHRSYPWIIWELNKSMLAQHRHMLMHLFSTLSSSGVKTISQ
GTGNSCRTANPAEQGNPRT*LTLCMDRVSQSGSTG*SSTREARVSVSSQRGKGAGRYG*WRDAADRVRDRVMMQLLSDIFVLAV
AEPGPGAAHRSPAAVPALGTLGVEIVKQPLSQTVQQI*GLRSDEDPIMPDSSDHIDHRGMGQTQPDDAILLGFGDGGGKNRKN
HD*LLIQTVSEHFKMKVAEMAPLAPAVLVENNSQVKGDTVLEMFHGGFQQSLHAHIQKQDNSESGRVL*FLNHHVTLLHHPQIIFI
FPALNDSN*FLR*IQASHDKELAQSALHRHS*AHPHNSKIFCSWFTCSRLTSGISKSLPRSLSSSLSNNCKYSFISSPKFLAIGPPGIRLGQ
ATVQINRSPPQ*ALPNARLL*ACWLDPVISSR*LDRKSPRQFLRKSTKEKSSRCTFRASGTTMK*MQAVRSSMVS*LICKKQKIKH*T
MLAWRTGG*IVLSSTRQATGSPARPS*KLSL*LKTITERRSRWPA*MIRQDEYTPGTLASASEKKRPRKQ*GTTMLSLKSSKAMPCG
*STKSSGAYKM*LLPSCTGSEAPDPSRYTYKASASIAYRAAAHNRRKSQRKAEL*PVHPLSAQYIAQIYTDVKAKV*KYPPNNHTRPA
HAQKPVTHSKKYAHFLKRPNCRHFRVPTLRHRNSTFKFRRPLKTSPAPPLTVARLSANHLPPSPNSNSSFAY*RAPKV*GILLMM

Fig. 24A

AdC6 020-DU172gp160(E1620) Nucleic Acids – SEQ ID NO: 5

CATCATCAATAATATACCTCAAACTTTTGGTGCGCGTTAATATGCAAATGAGCTGTTTGAATTTGGGGAGGGAGGAAGGTGAT
TGGCTGCGGGAGCGGCGACCGTTAGGGGCGGGGCGGGTGACGTTTTGATGACGTGGCTATGAGGCGGAGCCGGTTTGCAAG
TTCTCGTGGGAAAAGTGACGTCAAACGAGGTGTGGTTTGAACACGGAAATACTCAATTTTCCCGCGCTCTCTGACAGGAAATG
AGGTGTTTCTGGGCGGATGCAAGTGAAAACGGGCCATTTTCGCGCGAAAACTGAATGAGGAAGTGAAAATCTGAGTAATTTC
GCGTTTATGGCAGGGAGGAGTATTTGCCGAGGGCCGAGTAGACTTTGACCGATTACGTGGGGGTTTCGATTACCGTATTTTTC
ACCTAAATTTCCGCGTACGGTGTCAAAGTCCGGTGTTTTTACGTACGATATCATTTCCCCGAAAGTGCCACCTGACCGTAACTAT
AACGGTCCTAAGGTAGCGAAAGCTCAGATCTCCCGATCCCTATGGTGCACTCTCAGTACAATCTGCTCTGATGCCGCATAGTT
AAGCCAGTATCTGCTCCCTGCTTGTGTGTTGGAGGTCGCTGAGTAGTGCGCGAGCAAAATTTAAGCTACAACAAGGCAAGGCT
TGACCGACAATTGCATGAAGAATCTGCTTAGGGTTAGGCGTTTTGCGCTGCTTCGCGATGTACGGGCCAGATATACGCGTTGA
CATTGATTATTGACTAGTATGCCAAGTACGCCCCTATTGACGTCAATGACGGTAAATGGCCCGCCTGGCATTATGCCCAGTAC
ATGACCTTATGGGACTTTCCTACTTGGCAGTACATCTACGTATTAGTCATCGCTATTACCATGGTGATGCGGTTTTGGCAGTACA
TCAATGGGCGTGGATAGCGGTTTGACTCACGGGGATTTCCAAGTCTCCACCCCATTGACGTCAATGGGAGTTTGTTTTGGCACC
AAAATCAACGGGACTTTCCAAAATGTCGTAACAACTCCGCCCCATTGACGCAAATGGGCGGTAGGCGTGTACGGTGGGAGGT
CTATATAAGCAGAGCTCGTTTAGTGAACCGTCAGATCACTAGAAGCTTTATTGCGGTAGTTTATCACAGTTAAATTGCTAACGC
AGTCAGTGCTTCTGACACAACAGTCTCGAACTTAAGGCTAGAGTACTTAATACGACTCACTATAGGCTAGTTAAGGCTAGAGTT
CGACGCCACCATGCGCGTGATGGGCATCCTGCGCTCCTACCAGCAGTGGTGGATCTGGGGCATCCTGGGCTTCTGGATGCTGA
TGATCTGCAACGTGTGGGGCAACCTGTGGGTGACCGTGTACTACGGCGTGCCCGTGTGGAAGGAGGCCAAGACCACCCTGTT
CTGCGCCTCCGACGCCAAGGCCCACAAGGAGGAGGTGCACAACATCTGGGCCACCCACGCCTGCGTGCCCACCGACCCCAAC
CCCCAGGAGATCGTGCTGAAGAACGTGACCGAGAACTTCAACATGTGGAAGAACGACATGGTGGACCAGATGCACGAGGAC
ATCATCTCCCTGTGGGACCAGTCCCTGAAGCCCTGCGTGAAGCTGACCCCCCTGTGCGTGACCCTGAACTGCTCCGACGTGAA
GATCAAGGGCACCAACGCCACCTACAACAACGCCACCTACAACAACAACAACACCATCTCCGACATGAAGAACTGCTCCTTCAA
CACCACCACCGAGATCACCGACAAGAAGAAGAAGGAGTACGCCCTGTTCTACAAGCTGGACGTGGTGGCCCTGGACGGCAAG
GAGACCAACTCCACCAACTCCTCCGAGTACCGCCTGATCAACTGCAACACCTCCGCCGTGACCCAGGCCTGCCCCAAGGTGTCC
TTCGACCCCATCCCCATCCACTACTGCGCCCCCGCCGGCTACGCCATCCTGAAGTGCAACAACAAGACCTTCAACGGCACCGGC
CCCTGCAACAACGTGTCCACCGTGCAGTGCACCCACGGCATCAAGCCCGTGGTGTCCACCCAGCTGCTGCTGAACGGCTCCCT
GGCCGAGGAGGAGGTGGTGATCCGCTTCGAGAACCTGACCAACAACGCCAAGATCATCATCGTGCACCTGAACGAGTCCGTG
GAGATCAACTGCACCCGCCCCTCCAACAACACCCGCAAGTCCGTGCGCATCGGCCCCGGCCAGACCTTCTTCGCCACCGGCGA
CATCATCGGCGACATCCGCCAGGCCCACTGCAACATCTCCCGCAAGAAGTGGAACACCACCCTGCAGCGCGTGAAGGAGAAG
CTGAAGGAGAAGTTCCCCAACAAGACCATCCAGTTCGCCCCCTCCTCCGGCGGCGACCTGGAGATCACCACCCACTCCTTCAAC
TGCCGCGGCGAGTTCTTCTACTGCTACACCTCCGACCTGTTCAACTCCACCTACATGTCCAACAACACCGGCGGCGCCAACATC
ACCCTGCAGTGCCGCATCAAGCAGATCATCCGCATGTGGCAGGGCGTGGGCCAGGCCATGTACGCCCCCCCCATCGCCGGCA
ACATCACCTGCAAGTCCAACATCACCGGCCTGCTGCTGACCCGCGACGGCGGCAAGGAGAAGAACGACACCGAGACCTTCCG
CCCCGGCGGCGGCGACATGCGCGACAACTGGCGCTCCGAGCTGTACAAGTACAAGGTGGTGGAGATCAAGCCCCTGGGCATC
GCCCCCGACAAGGCCAAGCGCCGCGTGGTGGAGCGCGAGAAGCGCGCCGTGGGCATCGGCGCCGTGTTCCTGGGCTTCCTG
GGCGCCGCCGGCAGCACCATGGGCGCCGCCAGCATGACCCTGACCGTGCAGGCCCGCCAGCTGCTGAGCGGCATCGTGCAGC
AGCAGAGCAACCTGCTGCGCGCCATCGAGGCCCAGCAGCACATGCTGCAGCTGACCGTGTGGGGCATCAAGCAGCTGCAGAC
CCGCGTGCTGGCCATCGAGCGCTACCTGAAGGACCAGCAGCTGCTGGGCATCTGGGGCTGCAGCGGCAAGCTGATCTGCACC
ACCGCCGTGCCCTGGAACGCCAGCTGGAGCAACAAGAGCTACGAGGAGATCTGGGGCAACATGACCTGGATGCAGTGGGAC
CGCGAGATCAACAACTACACCAACACCATCTACAGCCTGCTGGAGGAGAGCCAGAACCAGCAGGAGAAGAACGAGAAGGAC
CTGCTGGCCCTGGACAGCTGGGAGAGCCTGTGGAGCTGGTTCAACATCACCAACTGGCTGTGGTACATCCGCATCTTCATCAT
CATCGTGGGCGGCCTGATCGGCCTGCGCATCATCTTCGCCGTGCTGAGCATCGTGAACCGCGTGCGCCAGGGCTACAGCCCCC
TGAGCTTCCAGACCCTGACCCCCAGCCCCGCGAGCCCGACCGCCTGGGCCGCATCGAGGAGGGCGGCGAGCAGGACC
GCGCCCGCAGCGTGCGCCTGGTGAACGGCTTCCTGGCCCTGGCCTGGGAGGACCTGCGCAGCCTGTGCCTGTTCAGCTACCAC
CGCCTGCGCGACCTGATCCTGATCGCCGCCCGCGCCGCCGCCCTGCTGGGCCGCAGCAGCCTGTGGGGCCTGCAGAAGGGCT
GGGAGGCCCTGAAGTACCTGGGCAGCCTGGTGCAGTACTGGGGCCTGGAGCTGAAGAAGAGCGCCATCAGCCTGTTCGACG
CCATCGCCATCACCGTGGCCGAGGGCACCGACCGCATCATCAACATCGTGCAGCGCATCAGCCGCGCCTTCTACAACATCCCCC
GCCGCATCCGCCAGGGCTTCGAGGCCACCCTGCAGTAAGGTACCTCTAGAGTCGACCCGGCGGCCAAACCGCTGATCAGCCT
CGACTGTGCCTTCTAGTTGCCAGCCATCTGTTGTTTGCCCCTCCCCCGTGCCTTCCTTGACCCTGGAAGGTGCCACTCCCACTGT
CCTTTCCTAATAAAATGAGGAAATTGCATCGCATTGTCTGAGTAGGTGTCATTCTATTCTGGGGGGTGGGGTGGGGCAGGACA

Fig. 24B

```
GCAAGGGGGAGGATTGGGAAGACAATAGCAGGCATGCTGGGGATGCGGTGGGCTCTATGGCTTCTGAGGCGGAAAGAACC
AGCAGATCTGCAGATCTGAATTCATCTATGTCGGGTGCGGAGAAAGAGGTAATGAAATGGCATTATGGGTATTATGGGTCTGC
ATTAATGAATCGGTCAGATATCGACATATGCTGGCCACCGTGCATGTGGCCTCGCACCCCCGCAAGACATGGCCCGAGTTCGA
GCACAACGTCATGACCCGCTGCAATGTGCACCTGGGCTCCGCCGAGGCATGTTCATGCCCTACCAGTGCAACATGCAATTTGT
GAAGGTGCTGCTGGAGCCCGATGCCATGTCCAGAGTGAGCCTGACGGGGGTGTTTGACATGAATGTGGAGCTGTGGAAAATT
CTGAGATATGATGAATCCAAGACCAGGTGCCGGGCCTGCGAATGCGGAGGCAAGCACGCCAGGCTTCAGCCCGTGTGTGTGG
AGGTGACGGAGGACCTGCGACCCGATCATTTGGTGTTGTCCTGCAACGGGACGGAGTTCGGCTCCAGCGGGGAAGAATCTGA
CTAGAGTGAGTAGTGTTTGGGGCTGGGTGTGAGCCTGCATGAGGGGCAGAATGACTAAAATCTGTGGTTTTCTGTGTGTTGC
AGCAGCATGAGCGGAAGCGCCTCCTTTGAGGGAGGGGTATTCAGCCCTTATCTGACGGGGCGTCTCCCCTCCTGGGCGGGAG
TGCGTCAGAATGTGATGGGATCCACGGTGGACGGCCGGCCCGTGCAGCCCGCGAACTCTTCAACCCTGACCTACGCGACCCTG
AGCTCCTCGTCCGTGGACGCAGCTGCCGCCGCAGCTGCTGCTTCCGCCGCCAGCGCCGTGCGCGGAATGGCCCTGGGCGCCG
GCTACTACAGCTCTCTGGTGGCCAACTCGAGTTCCACCAATAATCCCGCCAGCCTGAACGAGGAGAAGCTGCTGCTGCTGATG
GCCCAGCTCGAGGCCCTGACCCAGCGCCTGGGCGAGCTGACCCAGCAGGTGGCTCAGCTGCAGGCGGAGACGCGGGCCGCG
GTTGCCACGGTGAAAACCAAATAAAAAATGAATCAATAAATAAACGGAGACGGTTGTTGATTTTAACACAGAGTCTTGAATCT
TTATTTGATTTTTCGCGCGCGGTAGGCCCTGGACCACCGGTCTCGATCATTGAGCACCCGGTGGATCTTTTCCAGGACCCGGTA
GAGGTGGGCTTGGATGTTGAGGTACATGGGCATGAGCCCGTCCCGGGGGTGGAGGTAGCTCCATTGCAGGGCCTCGTGCTC
GGGGATGGTGTTGTAAATCACCCAGTCATAGCAGGGGCGCAGGGCGTGGTGCTGCACGATGTCCTTGAGGAGGAGACTGAT
GGCCACGGGCAGCCCCTTGGTGTAGGTGTTGACGAACCTGTTGAGCTGGGAGGGATGCATGCGGGGGGAGATGAGATGCAT
CTTGGCCTGGATCTTGAGATTGGCGATGTTCCCGCCCAGATCCCGCCGGGGGTTCATGTTGTGCAGGACCACCAGCACGGTGT
ATCCGGTGCACTTGGGGAATTTGTCATGCAACTTGGAAGGGAAGGCGTGAAAGAATTTGGAGACGCCCTTGTGACCGCCCAG
GTTTTCCATGCACTCATCCATGATGATGGCGATGGGCCCGTGGGCGGCGGCCTGGGCAAAGACGTTTCGGGGGTCGGACACA
TCGTAGTTGTGGTCCTGGGTGAGCTCGTCATAGGCCATTTTAATGAATTTGGGGCGGAGGGTGCCCGACTGGGGACGAAGG
TGCCCTCGATCCCGGGGGCGTAGTTGCCCTCGCAGATCTGCATCTCCCAGGCCTTGAGCTCGGAGGGGGGATCATGTCCACC
TGCGGGGCGATGAAAAAAACGGTTTCCGGGGCGGGGAGATGAGCTGGGCCGAAAGCAGGTTCCGGAGCAGCTGGGACTT
GCCGCAACCGGTGGGGCCGTAGATGACCCCGATGACCGGCTGCAGGTGGTAGTTGAGGGAGAGACAGCTGCCGTCCTCGCG
GAGGAGGGGGGCCACCTCGTTCATCATCTCGCGCACATGCATGTTCTCGCGCACGAGTTCCGCCAGGAGGCGCTCGCCCCCCA
GCGAGAGGAGCTCTTGCAGCGAGGCGAAGTTTTTCAGCGGCTTGAGTCCGTCGGCCATGGGCATTTTGGAGAGGGTCTGTTG
CAAGAGTTCCAGACGGTCCCAGAGCTCGGTGATGTGCTCTAGGGCATCTCGATCCAGCAGACCTCCTCGTTTCGCGGGTTGGG
GCGACTGCGGGAGTAGGGCACCAGGCGATGGGCGTCCAGCGAGGCCAGGGTCCGGTCCTTCCAGGGCCGCAGGGTCCGCGT
CAGCGTGGTCTCCGTCACGGTGAAGGGGTGCGCGCCGGGCTGGGCGCTTGCGAGGGTGCGCTTCAGGCTCATCCGGCTGGTC
GAGAACCGCTCCCGGTCGGCGCCCTGCGCGTCGGCCAGGTAGCAATTGAGCATGAGTTCGTAGTTGAGCGCCTCGGCCGCGT
GGCCCTTGGCGCGGAGCTTACCTTTGGAAGTGTGTCCGCAGACGGGACAGAGGAGGGACTTGAGGGCGTAGAGCTTGGGGG
CGAGGAAGACGGACTCGGGGGCGTAGGCGTCCGCGCCGCAGCTGGCGCAGACGGTCTCGCACTCCACGAGCCAGGTGAGGT
CGGGGCGGTTGGGGTCAAAAACGAGGTTTCCTCCGTGCTTTTTGATGCGTTTCTTACCTCTGGTCTCCATGAGCTCGTGTCCCC
GCTGGGTGACAAAGAGGCTGTCCGTGTCCCGTAGACCGACTTTATGGCCGGTCCTCGAGCGGGGTGCCGCGGTCCTCGTC
GTAGAGGAACCCGCCCACTCCGAGACGAAGGCCCGGGTCCAGGCCAGCACGAAGGAGGCCACGTGGGAGGGTAGCGGT
CGTTGTCCACCAGCGGGTCCACCTTCTCCAGGGTATGCAAGCACATGTCCCCCTCGTCCACATCCAGGAAGGTGATTGGCTTGT
AAGTGTAGGCCACGTGACCGGGGGTCCGGCCGGGGGGTATAAAAGGGGCGGGCCCCTGCTCGTCCTCACTGTCTTCCG
GATCGCTGTCCAGGAGCGCCAGCTGTTGGGGTAGGTATTCCCTCTCGAAGGCGGGCATGACCTCGGCACTCAGGTTGTCAGTT
TCTAGAAACGAGGAGGATTTGATATTGACGGTGCCGTTGGAGACGCCTTTCATGAGCCCTCGTCCATTTGGTCAGAAAAGAC
GATCTTTTTGTTGTCGAGCTTGGTGGCGAAGGAGCCGTAGAGGGCGTTGGAGAGCAGCTTGGCGATGGAGCGCATGGTCTGG
TTCTTTTCCTTGTCGGCGCGCTCCTTGGCGGCGATGTTGAGCTGCACGTACTCGCGCGCCACGCACTTCCATTCGGGGAAGACG
GTGGTGAGCTCGTCGGGCACGATTCTGACCCGCCAGCCGCGGTTGTGCAGGGTGATGAGGTCCACGCTGGTGGCCACCTCGC
CGCGCAGGGGCTCGTTGGTCCAGCAGAGGCGCCCGCCCTTGCGCGAGCAGAAGGGGGCAGCGGGTCCAGCATGAGCTCGT
CGGGGGGGTCGGCGTCCACGGTGAAGATGCCGGGCAGGAGCTCGGGGTCGAAGTAGCTGATGCAGGTGCCAGATTGTCCA
GCGCCGCTTGCCAGTCGCGCACGGCCAGCGCGCGCTCGTAGGGCTGAGGGCGTGCCCAGGGCATGGGTGCGTGAGCG
CGGAGGCGTACATGCCGCAGATGTCGTAGACGTAGAGGGGCTCCTCGAGGACGCCGATGTAGGTGGGGTAGCAGCGCCCCC
CGCGGATGCTGGCGCGCACGTAGTCGTACAGCTCGTGCGAGGGCGCGAGGAGCCCCGTGCCGAGGTTGGAGCGTTGCGGCT
TTTCGGCGCGGTAGACGATCTGGCGGAAGATGGCGTGGGAGTTGGAGGAGATGGTGGGCCTTTGGAAGATGTTGAAGTGGG
CGTGGGGCAGGCCGACCGAGTCCCTGATGAAGTGGGCGTAGGAGTCCTGCAGCTTGGCGACGAGCTCGGCGGTGACGAGGA
CGTCCAGGGCGCAGTAGTCGAGGGTCTCTTGGATGATGTCATACTTGAGCTGGCCCTTCTGCTTCCACAGCTCGCGGTTGAGA
```

Fig. 24C

```
AGGAACTCTTCGCGGTCCTTCCAGTACTCTTCGAGGGGGAACCCGTCCTGATCGGCACGGTAAGAGCCCACCATGTAGAACTG
GTTGACGGCCTTGTAGGCGCAGCAGCCCTTCTCCACGGGGAGGGCGTAAGCTTGCGCGGCCTTGCGCAGGGAGGTGTGGGT
GAGGGCGAAGGTGTCGCGCACCATGACCTTGAGGAACTGGTGCTTGAAGTCGAGGTCGTCGCAGCCGCCCTGCTCCCAGAGT
TGGAAGTCCGTGCGCTTCTTGTAGGCGGGGTTAGGCAAAGCGAAAGTAACATCGTTGAAGAGGATCTTGCCCGCGCGGGGCA
TGAAGTTGCGAGTGATGCGGAAAGGCTGGGGCACCTCGGCCCGGTTGTTGATGACCTGGGCGGCGAGGACGATCTCGTCGA
AGCCGTTGATGTTGTGCCCGACGATGTAGAGTTCCACGAATCGCGGGCGGCCCTTGACGTGGGGCAGCTTCTTGAGCTCGTCG
TAGGTGAGCTCGGCGGGGTCGCTGAGCCCGTGCTGCTCGAGGGCCCAGTCGGCGACGTGGGGGTTGGCGCTGAGGAAGGA
AGTCCAGAGATCCACGGCCAGGGCGGTCTGCAAGCGGTCCCGGTACTGACGGAACTGTTGGCCCACGGCCATTTTTTCGGGG
GTGACGCAGTAGAAGGTGCGGGGGTCGCCGTGCCAGCGGTCCCACTTGAGCTGGAGGGCGAGGTCGTGGGCGAGCTCGACG
AGCGGCGGGTCCCCGGAGAGTTTCATGACCAGCATGAAGGGGACGAGCTGCTTGCCGAAGGACCCCATCCAGGTGTAGGTTT
CCACATCGTAGGTGAGGAAGAGCCTTTCGGTGCGAGGATGCGAGCCGATGGGGAAGAACTGGATCTCCTGCCACCAGTTGGA
GGAATGGCTGTTGATGTGATGGAAGTAGAAATGCCGACGGCGCGCCGAGCACTCGTGCTTGTGTTTATACAAGCGTCCGCAG
TGCTCGCAACGCTGCACGGGATGCACGTGCTGCACGAGCTGTACCTGGGTTCCTTTGGCGAGGAATTTCAGTGGGCAGTGGA
GCGCTGGCGGCTGCATCTCGTGCTGTACTACGTCTTGGCCATCGGCGTGGCCATCGTCTGCCTCGATGGTGGTCATGCTGACG
AGCCCGCGCGGGAGGCAGGTCCAGACCTCGGCTCGGACGGGTCGGAGAGCGAGGACGAGGGCGCGCAGGCCGGAGCTGTC
CAGGGTCCTGAGACGCTGCGGAGTCAGGTCAGTGGGCAGCGGCGGCGCGCGGTTGACTTGCAGGAGCTTTTCCAGGGCGCG
CGGGAGGTCCAGATGGTACTTGATCTCCACGGCGCCGTTGGTGGCTACGTCCACGGCTTGCAGGGTGCCGTGCCCCTGGGGC
GCCACCACCGTGCCCCGTTTCTTCTTGGGCGCTGCTTCCATGTCGGTCAGAAGCGGCGGCGAGGACGCGCGCCGGGCGGCAG
GGGCGGCTCGGGGCCCGGAGGCAGGGCGGCAGGGGCACGTCGGCGCCGCGCGCGGGCAGGTTCTGGTACTGCGCCCGGA
GAAGACTGGCGTGAGCGACGACGCGACGGTTGACGTCCTGGATCTGACGCCTCTGGGTGAAGGCCACGGGACCCGTGAGTTT
GAACCTGAAAGAGAGTTCGACAGAATCAATCTCGGTATCGTTGACGGCGGCCTGCCGCAGGATCTCTTGCACGTCGCCCGAGT
TGTCCTGGTAGGCGATCTCGGTCATGAACTGCTCGATCTCCTCCTCCTGAAGGTCTCCGCGGCCGGCGCGCTCGACGGTGGCC
GCGAGGTCGTTGGAGATGCGGCCCATGAGCTGCGAGAAGGCGTTCATGCCGGCCTCGTTCCAGACGCGGCTGTAGACCACGG
CTCCGTCGGGGTCGCGCGCGCGCATGACCACCTGGGCGAGGTTGAGCTCGACGTGGCGCGTGAAGACCGCGTAGTTGCAGA
GGCGCTGGTAGAGGTAGTTGAGCGTGGTGGCGATGTGCTCGGTGACGAAGAAGTACATGATCCAGCGGCGGAGCGGCATCT
CGCTGACGTCGCCCAGGGCTTCCAAGCGTTCCATGGCCTCGTAGAAGTCCACGGCGAAGTTGAAAAACTGGGAGTTGCGCGC
CGAGACGGTCAACTCCTCCTCCAGAAGACGGATGAGCTCGGCGATGGTGGCGCGCACCTCGCGCTCGAAGGCCCCGGGGGG
CTCCTCTTCCATCTCCTCCTCTTCCTCCTCCACTAACATCTCTTCTACTTCCTCCTCAGGAGGCGGTGGCGGGGAGGGGCCCTG
CGTCGCCGGCGGCGCACGGGCAGACGGTCGATGAAGCGCTCGATGGTCTCCCCGCGCCGGCGACGCATGGTCTCGGTGACG
GCGCGCCCGTCCTCGCGGGGCCGCAGCATGAAGACGCCGCCGCGCATCTCCAGGTGGCCGCCGGGGGGGTCTCCGTTGGGC
AGGGAGAGGGCGCTGACGATGCATCTTATCAATTGACCCGTAGGGACTCCGCGCAAGGACCTGAGCGTCTCGAGATCCACGG
GATCCGAAAACCGCTGAACGAAGGCTTCGAGCCAGTCGCAGTCGCAAGGTAGGCTGAGCCCGGTTTCTTGTTCTTCGGGTATT
TGGTCGGGAGGCGGGCGGGCGATGCTGCTGGTGATGAAGTTGAAGTAGGCGGTCCTGAGACGGCGGATGGTGGCGAGGAG
CACCAGGTCCTTGGGCCCGGCTTGCTGGATGCGCAGACGGTCGGCCATGCCCAGGCGTGGTCCTGACACCTGGCGAGGTCC
TTGTAGTAGTCCTGCATGAGCCGCTCCACGGGCACCTCCTCCTCGCCCGCGCGGCCGTGCATGCGCGTGAGCCCGAACCCGCG
CTGCGGCTGGACGAGCGCCAGGTCGGCGACGACGCGCTCGGTGAGGATGGCCTGCTGGATCTGGGTGAGGGTGGTCTGGAA
GTCGTCGAAGTCGACGAAGCGGTGGTAGGCTCCGGTGTTGATGGTGTAGGAGCAGTTGGCCATGACGGACCAGTTGACGGT
CTGGTGGCCGGGTCGCACGAGCTCGTGGTACTTGAGGCGCGAGTAGGCGCGCGTGTCGAAGATGTAGTCGTTGCAGGCGCG
CACGAGGTACTGGTATCCGACGAGGAAGTGCGGCGGCGGCTGGCGGTAGAGCGGCCATCGCTCGGTGGCGGGGCGCCGG
GCGCGAGGTCCTCGAGCATGAGGCGGTGGTAGCCGTAGATGTACCTGGACATCCAGGTGATGCCGGCGGCGGTGGTGGAGG
CGCGCGGGAACTCGCGGACGCGGTTCCAGATGTTGCGCAGCGGCAGGAAGTAGTTCATGGTGGCCGCGGTCTGGCCCGTGA
GGCGCGCGCAGTCGTGGATGCTCTAGACATACGGGCAAAAACGAAAGCGGTCAGCGGCTCGACTCCGTGGCCTGGAGGCTA
AGCGAACGGGTTGGGCTGCGCGTGTACCCCGGTTCGAATCTCGAATCAGGCTGGAGCCGCAGCTAACGTGGTACTGGCACTC
CCGTCTCGACCCAAGCCTGCTAACGAAACCTCCAGGATACGGAGGCGGGTCGTTTTTGGCCTTGGTCGCTGGTCATGAAAAA
CTAGTAAGCGCGGAAAGCGGCCGCCCGCGATGGCTCGCTGCCGTAGTCTGGAGAAAGAATCGCCAGGGTTGCGTTGCGGTGT
GCCCCGGTTCGAGCCTCAGCGCTCGGCGCCGGCCGGATTCCGCGGCTAACGTGGGCGTGGCTGCCCCGTCGTTTCCAAGACCC
CTTAGCCAGCCGACTTCTCCAGTTACGGAGCGAGCCCCTCTTTTTTTTTCTTGTGTTTTTGCCAGATGCATCCCGTACTGCGGCA
GATGCGCCCCACCCTCCACCACAACCGCCCCTACCGCAGCAGCAGCAACAGCCGGCGCTTCTGCCCCCGCCCCAGCAGCAGC
CAGCCACTACCGCGGCGGCCGCCGTGAGCGGAGCCGGCGTTCAGTATGACCTGGCCTTGGAAGAGGGCGAGGGGCTGGCGC
GGCTGGGGGCGTCGTCGCCGGAGCGGCACCCGCGCGTGCAGATGAAAAGGGACGCTCGCGAGGCCTACGTGCCCAAGCAGA
ACCTGTTCAGAGACAGGAGCGGCGAGGAGCCCGAGGAGATGCGCGCCTCCCGCTTCCACGCGGGGCGGGAGCTGCGGCGCG
```

Fig. 24D

```
GCCTGGACCGAAAGCGGGTGCTGAGGGACGAGGATTTCGAGGCGGACGAGCTGACGGGGATCAGCCCCGCGCGCGCAC
GTGGCCGCGGCCAACCTGGTCACGGCGTACGAGCAGACCGTGAAGGAGGAGAGCAACTTCCAAAAATCCTTCAACAACCACG
TGCGCACGCTGATCGCGCGCGAGGAGGTGACCCTGGGCCTGATGCACCTGTGGGACCTGCTGGAGGCCATCGTGCAGAACCC
CACGAGCAAGCCGCTGACGGCGCAGCTGTTTCTGGTGGTGCAGCACAGTCGGGACAACGAGACGTTCAGGGAGGCGCTGCT
GAATATCACCGAGCCCGAGGGCCGCTGGCTCCTGGACCTGGTGAACATTTTGCAGAGCATCGTGGTGCAGGAGCGCGGGCTG
CCGCTGTCCGAGAAGCTGGCGGCCATCAACTTCTCGGTGCTGAGTCTGGGCAAGTACTACGCTAGGAAGATCTACAAGACCCC
GTACGTGCCCATAGACAAGGAGGTGAAGATCGACGGGTTTTACATGCGCATGACCCTGAAAGTGCTGACCCTGAGCGACGAT
CTGGGGGTGTACCGCAACGACAGGATGCACCGCGCGGTGAGCGCCAGCCGCCGGCGCGAGCTGAGCGACCAGGAGCTGATG
CACAGCCTGCAGCGGGCCCTGACCGGGGCCGGGACCGAGGGGGAGAGCTACTTTGACATGGGCGCGGACCTGCGCTGGCAG
CCCAGCCGCCGGGCCTTGGAAGCTGCCGGCGGTTCCCCCTACGTGGAGGAGGTGGACGATGAGGAGGAGGAGGGCGAGTAC
CTGGAAGACTGATGGCGCGACCGTATTTTTGCTAGATGCAGCAACAGCCACCGCCGCCGCCTCCTGATCCCGCGATGCGGGCG
GCGCTGCAGAGCCAGCCGTCCGGCATTAACTCCTCGGACGATTGGACCCAGGCCATGCAACGCATCATGGCGCTGACGACCC
GCAATCCCGAAGCCTTTAGACAGCAGCCTCAGGCCAACCGGCTCTCGGCCATCCTGGAGGCCGTGGTGCCCTCGCGCTCGAAC
CCCACGCACGAGAAGGTGCTGGCCATCGTGAACGCGCTGGTGGAGAACAAGGCCATCCGCGGTGACGAGGCCGGGCTGGTG
TACAACGCGCTGCTGGAGCGCGTGGCCCGCTACAACAGCACCAACGTGCAGACGAACCTGGACCGCATGGTGACCGACGTGC
GCGAGGCGGTGTCGCAGCGCGAGCGGTTCCACCGCGAGTCGAACCTGGGCTCCATGGTGGCGCTGAACGCCTTCCTGAGCAC
GCAGCCCGCCAACGTGCCCCGGGGCCAGGAGGACTACACCAACTTCATCAGCGCGCTGCGGCTGATGGTGGCCGAGGTGCCC
CAGAGCGAGGTGTACCAGTCGGGGCCGGACTACTTCTTCCAGACCAGTCGCCAGGGCTTGCAGACCGTGAACCTGAGCCAGG
CTTTCAAGAACTTGCAGGGACTGTGGGGCGTGCAGGCCCCGGTCGGGGACCGCGCGACGGTGTCGAGCCTGCTGACGCCGA
ACTCGCGCCTGCTGCTGCTGCTGGTGGCGCCCTTCACGGACAGCGGCAGCGTGAGCCGCGACTCGTACCTGGGCTACCTGCTT
AACCTGTACCGCGAGGCCATCGGACAGGCGCACGTGGACGAGCAGACCTACCAGGAGATCACCCACGTGAGCCGCGCGCTG
GGCCAGGAGGACCCGGGCAACCTGGAGGCCACCCTGAACTTCCTGCTGACCAACCGGTCGCAGAAGATCCCGCCCCAGTACG
CGCTGAGCACCGAGGAGGAGCGCATCCTGCGCTACGTGCAGCAGAGCGTGGGCTGTTCCTGATGCAGGAGGGGGCCACGC
CCAGCGCGGCGCTCGACATGACCGCGCGCAACATGGAGCCCAGCATGTACGCCCGCAACCGCCCGTTCATCAATAAGCTGATG
GACTACTTGCATCGGGCGGCCGCCATGAACTCGGACTACTTTACCAACGCCATCTTGAACCCGCACTGGCTCCGCCGCCCGG
GTTCTACACGGGCGAGTACGACATGCCCGACCCCAACGACGGGTTCCTGTGGGACGACGTGGACAGCAGCGTGTTCTCGCCG
CGTCCAGGAACCAATGCCGTGTGGAAGAAAGAGGGCGGGGACCGGCGGCCGTCCTCGGCGCTGTCCGGTCGCGCGGGTGCT
GCCGCGGCGGTGCCCGAGGCCGCCAGCCCCTTCCCGAGCCTGCCCTTTTCGCTGAACAGCGTGCGCAGCAGCGAGCTGGGTC
GGCTGACGCGACCGCGCCTGCTGGGCGAGGAGGAGTACCTGAACGACTCCTTGTTGAGGCCCGAGCGCGAGAAGAACTTCCC
CAATAACGGGATAGAGAGCCTGGTGGACAAGATGAGCCGCTGGAAGACGTACGCGCACGAGCACAGGGACGAGCCCCGAGC
TAGCAGCGCAGGCACCCGTAGACGCCAGCGGCACGACAGGCAGCGGGGACTGGTGTGGGACGATGAGGATTCCGCCGACGA
CAGCAGCGTGTTGGACTTGGGTGGGAGTGGTGGTAACCCGTTCGCTCACCTGCGCCCCCGTATCGGGCGCCTGATGTAAGAA
TCTGAAAAAATAAAAGACGGTACTCACCAAGGCCATGGCGACCAGCGTGCGTTCTTCTCTGTTGTTTGTAGTAGTATGATGAG
GCGCGTGTACCCGGAGGGTCCTCCTCCCTCGTACGAGAGCGTGATGCAGCAGGCGGTGGCGGCGGCGATGCAGCCCCGCTG
GAGGCGCCTTACGTGCCCCGCGGTACCTGGCGCCTACGGAGGGGCGGAACAGCATTCGTTACTCGGAGCTGGCACCCTTGT
ACGATACCACCCGGTTGTACCTGGTGGACAACAAGTCGGCAGACATCGCCTCGCTGAACTACCAGAACGACCACAGCAACTTC
CTGACCACCGTGGTGCAGAACAACGATTTCACCCCCACGGAGGCCAGCACCCAGACCATCAACTTTGACGAGCGCTCGCGGTG
GGGCGGCCAGCTGAAAACCATCATGCACACCAACATGCCCAACGTGAACGAGTTCATGTACAGCAACAAGTTCAAGGCGCGG
GTGATGGTCTCGCGCAAGACCCCCAACGGGGTGGATGATGATTATGATGGTAGTCAGGACGAGCTGACCTACGAGTGGGTGG
AGTTTGAGCTGCCCGAGGGCAACTTCTCGGTGACCATGACCATCGATCTGATGAACAACGCCATCATCGACAACTACTTGGCG
GTGGGGCGGCAGAACGGGGTGCTGGAGAGCGACATCGGCGTGAAGTTCGACACGCGCAACTTCCGGCTGGGCTGGGACCCC
GTGACCGAGCTGGTGATGCCGGGCGTGTACACCAACGAGGCCTTCCACCCCGACATCGTCCTGCTGCCCGGCTGCGGCGTGG
ACTTCACCGAGAGCCGCCTCAGCAACCTGCTGGGCATCCGCAAGCGGCAGCCCTTCAGGAGGGCTTCCAGATCCTGTACGAG
GACCTGGAGGGGGCAACATCCCCGCGCTCTTGGATGTCGAAGCCTACGAGAAAAGCAAGGAGGATAGCACCGCCGCGGCG
ACCGCAGCCGTGGCCACCGCCTCTACCGAGGTGCGGGGCGATAATTTTGCTAGCGCTGCGGCAGCGGCCGAGGCGGCTGAAA
CCGAAAGTAAGATAGTCATCCAGCCGGTGGAGAAGGACAGCAAGGACAGGAGCTACAACGTGCTCGCGGACAAGAAAAACA
CCGCCTACCGCAGCTGGTACCTGGCCTACAACTACGGCGACCCCGAGAAGGGCGTGCGCTCCTGGACGCTGCTCACCACCTCG
GACGTCACCTGCGGCGTGGAGCAAGTCTACTGGTCGCTGCCCGACATGATGCAAGACCCGGTCACCTTCCGCTCCACGCGTCA
AGTTAGCAACTACCCGGTGGTGGGCGCCGAGCTCCTGCCCGTCTACTCCAAGAGCTTCTTCAACGAGCAGGCCGTCTACTCGC
AGCAGCTGCGCGCCTTCACCTCGCTCACGCACGTCTTCAACCGCTTCCCCGAGAACCAGATCCTCGTCCGCCCGCCCGCGCCCA
CCATTACCACCGTCAGTGAAAACGTTCCTGCTCTCACAGATCACGGGACCCTGCCGCTGCGCAGCAGTATCCGGGGAGTCCAG
```

Fig. 24E

CGCGTGACCGTCACTGACGCCAGACGCCGCACCTGCCCCTACGTCTACAAGGCCCTGGGCGTAGTCGCGCCGCGCGTCCTCTC
GAGCCGCACCTTCTAAAAAATGTCCATTCTCATCTCGCCCAGTAATAACACCGGTTGGGGCCTGCGCGCGCCCAGCAAGATGT
ACGGAGGCGCTCGCCAACGCTCCACGCAACACCCCGTGCGCGTGCGCGGGCACTTCCGCGCTCCCTGGGGCGCCCTCAAGGG
CCGCGTGCGCTCGCGCACCACCGTCGACGACGTGATCGACCAGGTGGTGGCCGACGCGCGCAACTACACGCCCGCCGCCGCG
CCCGTCTCCACCGTGGACGCCGTCATCGACAGCGTGGTGGCCGACGCGCGCCGGTACGCCCGCACCAAGAGCCGGCGGCGGC
GCATCGCCCGGCGGCACCGGAGCACCCCGCCATGCGCGCGGCGCGAGCCTTGCTGCGCAGGGCCAGGCGCACGGGACGCA
GGGCCATGCTCAGGGCGGCCAGACGCGCGGCCTCCGGCAGCAGCAGCGCCGGCAGGACCCGCAGACGCGCGGCCACGGCG
GCGGCGGCGGCCATCGCCAGCATGTCCGCCCGCGGCGCGGCAACGTGTACTGGGTGCGCGACGCCGCCACCGGTGTGCGC
GTGCCCGTGCGCACCCGCCCCCCTCGCACTTGAAGATGCTGACTTCGCGATGTTGATGTGTCCCAGCGGCGAGGAGGATGTCC
AAGCGCAAATACAAGGAAGAGATGCTCCAGGTCATCGCGCCTGAGATCTACGGCCCCGCGGCGGCGGTGAAGGAGGAAAGA
AAGCCCCGCAAACTGAAGCGGGTCAAAAAGGACAAAAAGGAGGAGGAAGATGACGGACTGGTGGAGTTTGTGCGCGAGTTC
GCCCCCCGGCGGCGCGTGCAGTGGCGCGGGCGGAAAGTGAAACCGGTGCTGCGGCCCGGCACCACGGTGGTCTTCACGCCC
GGCGAGCGTTCCGGCTCCGCCTCCAAGCGCTCCTACGACGAGGTGTACGGGGACGAGGACATCCTCGAGCAGGCGGTCGAGC
GTCTGGGCGAGTTTGCGTACGGCAAGCGCAGCCGCCCCGCGCCCTTGAAAGAGGAGGCGGTGTCCATCCCGCTGGACCACGG
CAACCCCACGCCGAGCCTGAAGCCGGTGACCCTGCAGCAGGTGCTACCGAGCGCGGCGCCGCGCCGGGGCTTCAAGCGCGA
GGGCGGCGAGGATCTGTACCCGACCATGCAGCTGATGGTGCCCAAGCGCCAGAAGCTGGAGGACGTGCTGGAGCACATGAA
GGTGGACCCCGAGGTGCAGCCCGAGGTCAAGGTGCGGCCCATCAAGCAGGTGGCCCCGGGCCTGGGCGTGCAGACCGTGGA
CATCAAGATCCCCACGGAGCCCATGGAAACGCAGACCGAGCCCGTGAAGCCCAGCACCAGCACCATGGAGGTGCAGACGGAT
CCCTGGATGCCAGCACCAGCTTCCACCAGCACTCGCCGAAGACGCAAGTACGGCGCGGCCAGCCTGCTGATGCCCAACTACGC
GCTGCATCCTTCCATCATCCCCACGCCGGGCTACCGCGGCACGCGCTTCTACCGCGGCTACACCAGCAGCCGCCGCCGCAAGA
CCACCACCCGCCGCCGTCGTCGCAGCCGCCGCAGCAGCACCGCGACTTCCGCCTTGGTGCGGAGAGTGTATCGCAGCGGGCG
CGAGCCTCTGACCCTGCCGCGCGCGCGCTACCACCCGAGCATCGCCATTTAACTACCGCCTCCTACTTGCAGATATGGCCCTCA
CATGCCGCCTCCGCGTCCCCATTACGGGCTACCGAGGAAGAAAGCCGCGCCGTAGAAGGCTGACGGGGAACGGGCTGCGTC
GCCATCACCACCGGCGGCGGCGCGCCATCAGCAAGCGGTTGGGGGGAGGCTTCCTGCCCGCGCTGATCCCCATCATCGCCGC
GGCGATCGGGGCGATCCCCGGCATAGCTTCCGTGGCGGTGCAGGCCTCTCAGCGCCACTGAGACACAAAAAAGCATGGATTT
GTAATAAAAAAAAAAATGGACTGACGCTCCTGGTCCTGTGATGTGTGTTTTTAGATGGAAGACATCAATTTTTCGTCCCTGGCA
CCGCGACACGGCACGCGGCCGTTTATGGGCACCTGGAGCGACATCGGCAACAGCCAACTGAACGGGGCGCCTTCAATTGGA
GCAGTCTCTGGAGCGGGCTTAAGAATTTCGGGTCCACGCTCAAAACCTATGGCAACAAGGCGTGGAACAGCAGCACAGGGCA
GGCGCTGAGGGAAAAGCTGAAAGAACAGAACTTCCAGCAGAAGGTGGTTGATGGCCTGGCCTCAGGCATCAACGGGGTGGT
TGACCTGGCCAACCAGGCCGTGCAGAAACAGATCAACAGCCGCCTGGACGCGGTCCCGCCCGCGGGGTCCGTGGAGATGCCC
CAGGTGGAGGAGGAGCTGCCTCCCCTGGACAAGCGCGGCGACAAGCGACCGCGTCCCGACGCGGAGGAGACGCTGCTGACG
CACACGGACGAGCCGCCCCCGTACGAGGAGGCGGTGAAACTGGGCCTGCCCACCACGCGGCCCGTGGCGCCTCTGGCCACCG
GAGTGCTGAAACCCAGCAGCAGCCAGCCCGCGACCCTGGACTTGCCTCCGCCTCGCCCCTCCACAGTGGCTAAGCCCCTGCCG
CCGGTGGCCGTCGCGTCGCGCGCCCCCGAGGCCGCCCCAGGCGAACTGGCAGAGCACTCTGAACAGCATCGTGGGTCTGG
GAGTGCAGAGTGTGAAGCGCCGCCGCTGCTATTAAAAGACACTGTAGCGCTTAACTTGCTTGTCTGTGTATATGTATGTCC
GCCGACCAGAAGGAGGAGTGTGAAGAGGCGCGTCGCCGAGTTGCAAGATGGCCACCCCATCGATGCTGCCCCAGTGGGCGT
ACATGCACATCGCCGGACAGGACGCTTCGGAGTACCTGAGTCCGGGTCTGGTGCAGTTCGCCCGCGCCACAGACACCTACTTC
AGTCTGGGGAACAAGTTTAGGAACCCCACGGTGGCGCCCACGCACGATGTGACCACCGACCGCAGCCAGCGGCTGACGCTGC
GCTTCGTGCCCGTGGACCGCGAGGACAACACCTACTCGTACAAAGTGCGCTACACGCTGGCCGTGGGCGACAACCGCGTGCT
GGACATGGCCAGCACCTACTTTGACATCCGCGGCGTGCTGGACCGGGCCCTAGCTTCAAACCCTACTCTGGCACCGCCTACA
ACAGCCTAGCTCCCAAGGGAGCTCCCAATTCCAGCCAGTGGGAGCAAGCAAAAACAGGCAATGGGGGAACTATGGAAACACA
CACATATGGTGTGGCCCCAATGGGCGGAGAGAATATTACAAAAGATGGTCTTCAAATTGGAACTGACGTTACAGCGAATCAG
AATAAACCAATTTATGCCGACAAAACATTTCAACCAGAACCGCAAGTAGGAGAAGAAAATTGGCAAGAAACTGAAAACTTTTA
TGGCGGTAGAGCTCTTAAAAAAGACACAAACATGAAACCTTGCTATGGCTCCTATGCTAGACCCACCAATGAAAAGGAGGTC
AAGCTAAACTTAAAGTTGGAGATGATGGAGTTCCAACCAAAGAATTCGACATAGACCTGGCTTTCTTTGATACTCCCGGTGGC
ACCGTGAACGGTCAAGACGAGTATAAAGCAGACATTGTCATGTATACCGAAAACACGTATTTGGAAACTCCAGACACGCATGT
GGTATACAAACCAGGCAAGGATGATGCAAGTTCTGAAATTAACCTGGTTCAGCAGTCTATGCCCAACAGACCCAACTACATTG
GGTTCAGGGACAACTTTATCGGTCTTATGTACTACAACAGCACTGGCAATATGGGTGTGCTTGCTGGTCAGGCCTCCCAGCTGA
ATGCTGTGGTTGATTTGCAAGACAGAAACACCGAGCTGTCCTACCAGCTCTTGCTTGACTCTTTGGGTGACAGAACCCGGTATT
TCAGTATGTGGAACCAGGCGGTGGACAGTTATGACCCCGATGTGCGCATCATCGAAAACCATGGTGTGGAGGATGAATTGCC
AAACTATTGCTTCCCCTTGGACGGCTCTGGCACTAACGCCGCATACCAAGGTGTGAAAGTAAAAGATGGTCAAGATGGTGATG

Fig. 24F

```
TTGAGAGTGAATGGGAAAATGACGATACTGTTGCAGCTCGAAATCAATTATGTAAAGGTAACATTTTCGCCATGGAGATTAAT
CTCCAGGCTAACCTGTGGAGAAGTTTCCTCTACTCGAACGTGGCCCTGTACCTGCCCGACTCCTACAAGTACACGCCGACCAAC
GTCACGCTGCCGACCAACACCAACACCTACGATTACATGAATGGCAGAGTGACACCTCCCTCGCTGGTAGACGCCTACCTCAAC
ATCGGGGCGCGCTGGTCGCTGGACCCCATGGACAACGTCAACCCCTTCAACCACCACCGCAACGCGGGCCTGCGCTACCGCTC
CATGCTCCTGGGCAACGGGCGCTACGTGCCCTTCCACATCCAGGTGCCCCAAAAGTTTTTCGCCATCAAGAGCCTCCTGCTCCT
GCCCGGGTCCTACACCTACGAGTGGAACTTCCGCAAGGACGTCAACATGATCCTGCAGAGCTCCCTAGGCAACGACCTGCGCA
CGGACGGGGCCTCCATCGCCTTCACCAGCATCAACCTCTACGCCACCTTCTTCCCCATGGCGCACAACACCGCCTCCACGCTCG
AGGCCATGCTGCGCAACGACACCAACGACCAGTCCTTCAACGACTACCTCTCGGCGGCCAACATGCTCTACCCCATCCCGGCCA
ACGCCACCAACGTGCCCATCTCCATCCCCTCGCGCAACTGGGCCGCCTTCCGCGGATGGTCCTTCACGCGCCTGAAGACCCGCG
AGACGCCCTCGCTCGGCTCCGGGTTCGACCCCTACTTCGTCTACTCGGGCTCCATCCCCTACCTAGACGGCACCTTCTACCTCAA
CCACACCTTCAAGAAGGTCTCCATCACCTTCGACTCCTCCGTCAGCTGGCCCGGCAACGACCGCCTCCTGACGCCCAACGAGTT
CGAAATCAAGCGCACCGTCGACGGAGAGGGATACAACGTGGCCCAGTGCAACATGACCAAGGACTGGTTCCTGGTCCAGATG
CTGGCCCACTACAACATCGGCTACCAGGGCTTCTACGTGCCCGAGGGCTACAAGGACCGCATGTACTCCTTCTTCCGCAACTTC
CAGCCCATGAGCCGCCAGGTCGTGGACGAGGTCAACTACAAGGACTACCAGGCCGTCACCCTGGCCTACCAGCACAACAACTC
GGGCTTCGTCGGCTACCTCGCGCCCACCATGCGCCAGGGCCAGCCCTACCCCGCCAACTACCCCTACCCGCTCATCGGCAAGA
GCGCCGTCGCCAGCGTCACCCAGAAAAAGTTCCTCTGCGACCGGGTCATGTGGCGCATCCCCTTCTCCAGCAACTTCATGTCCA
TGGGCGCGCTCACCGACCTCGGCCAGAACATGCTCTACGCCAACTCCGCCCACGCGCTAGACATGAATTTCGAAGTCGACCCC
ATGGATGAGTCCACCCTTCTCTATGTTGTCTTCGAAGTCTTCGACGTCGTCCGAGTGCACCAGCCCCACCGCGGCGTCATCGAA
GCCGTCTACCTGCGCACGCCCTTCTCGGCCGGCAACGCCACCACCTAAGCCGCTCTTGCTTCTTGCAAGATGACGGCGGGCTCC
GGCGAGCAGGAGCTCAGGGCCATCCTCCGCGACCTGGGCTGCGGGCCCTGCTTCCTGGGCACCTTCGACAAGCGCTTCCCTG
GATTCATGGCCCCGCACAAGCTGGCCTGCGCCATCGTGAACACGGCCGGCCGCGAGACCGGGGGCGAGCACTGGCTGGCCTT
CGCCTGGAACCCGCGCTCCCACACATGCTACCTCTTCGACCCCTTCGGGTTCTCGGACGAGCGCCTCAAGCAGATCTACCAGTT
CGAGTACGAGGGCCTGCTGCGTCGCAGCGCCCTGGCCACCGAGGACCGCTGCGTCACCCTGGAAAAGTCCACCCAGACCGTG
CAGGGTCCGCGCTCGGCCGCCTGCGGGCTCTTCTGCTGCATGTTCCTGCACGCCTTCGTGCACTGGCCCGACCGCCCCATGGAC
AAGAACCCCACCATGAACTTACTGACGGGGGTGCCCAACGGCATGCTCCAGTCGCCCCAGGTGGAACCCACCCTGCGCCGCAA
CCAGGAAGCGCTCTACCGCTTCCTCAATGCCCACTCCGCCTACTTTCGCTCCCACCGCGCGCGCATCGAGAAGGCCACCGCCTT
CGACCGCATGAATCAAGACATGTAAAAAACCGGTGTGTGTATGTGAATGCTTTATTCATAATAAACAGCACATGTTTATGCCAC
CTTCTCTGAGGCTCTGACTTTATTTAGAAATCGAAGGGGTTCTGCCGGCTCTCGGCATGGCCCGCGGGCAGGGATACGTTGCG
GAACTGGTACTTGGGCAGCCACTTGAACTCGGGGATCAGCAGCTTGGGCACGGGGAGGTCGGGGAACGAGTCGCTCCACAG
CTTGCGCGTGAGTTGCAGGGCGCCCAGCAGGTCGGGCGCGGAGATCTTGAAATCGCAGTTGGGACCCGCGTTCTGCGCGCGA
GAGTTGCGGTACACGGGGTTGCAGCACTGGAACACCATCAGGGCCGGGTGCTTCACGCTTGCCAGCACCGTCGCGTCGGTGA
TGCCCTCCACGTCCAGATCCTCGGCGTTGGCCATCCCGAAGGGGGTCATCTTGCAGGTCTGCCGCCCCATGCTGGGCACGCAG
CCGGGCTTGTGGTTGCAATCGCAGTGCAGGGGATCAGCATCATCTGGGCCTGCTCGGAGCTCATGCCCGGGTACATGGCCTT
CATGAAAGCCTCCAGCTGGCGGAAGGCCTGCTGCGCCTTGCCGCCCTCGGTGAAGAAGACCCCGCAGGACTTGCTAGAGAAC
TGGTTGGTGGCGCAGCCGGCGTCGTGCACGCAGCAGCGCGCGTCGTTGTTGGCCAGCTGCACCACGCTGCGCCCCAGCGGT
TCTGGGTGATCTTGGCCCGGTTGGGGTTCTCCTTCAGCGCGCGCTGCCCGTTCTCGCTCGCCACATCCATCTCGATAGTGTGCT
CCTTCTGGATCATCACGGTCCCGTGCAGGCACCGCAGCTTGCCCTCGGCTTCGGTGCAGCCGTGCAGCCACAGCGCGCAGCCG
GTGCACTCCCAGTTCTTGTGGGCGATCTGGGAGTGCGAGTGCACGAAGCCCTGCAGGAAGCGGCCCATCATCGCGGTCAGGG
TCTTGTTGCTGGTGAAGGTCAGCGGGATGCCGCGGTGCTCCTCGTTCACATACAGGTGGCAGATGCGGCGGTACACCTCGCCC
TGCTCGGGCATCAGCTGGAAGGCGGACTTCAGGTCGCTCTCCACGCGGTACCGGTCCATCAGCAGCGTCATCACTTCCATGCC
CTTCTCCCAGGCCGAAACGATCGGCAGGCTCAGGGGGTTCTTCACCGCCATTGTCATCTTAGTCGCCGCCGCCGAGGTCAGGG
GGTCGTTCTCGTCCAGGGTCTCAAACACTCGCTTGCCGTCCTTCTCGATGATGCGCACGGGGGAAAGCTGAAGCCCACGGCC
GCCAGCTCCTCCTCGGCCTGCCTTTCGTCCTCGCTGTCCTGGCTGATGTCTTGCAAAGGCACATGCTTGGTCTTGCGGGGTTTCT
TTTTGGGCGGCAGAGGCGGCGGCGATGTGCTGGGAGAGCGCGAGTTCTCGTTCACCACGACTATTTCTTCTTCTTGGCCGTCG
TCCGAGACCACGCGGCGGTAGGCATGCCTCTTCTGGGGCAGAGGCGGAGGCGACGGGCTCTCGCGGTTCGGCGGGCGGCTG
GCAGAGCCCCTTCCGCGTTCGGGGTGCGCTCCTGGCGGCGCTGCTCTGACTGACTTCCTCCGCGGCCGGCCATTGTGTTCTCC
TAGGGAGCAACAACAAGCATGGAGACTCAGCCATCGTCGCCAACATCGCCATCTGCCCCCGCCGCCACCGCCGACGAGAACCA
GCAGCAGAATGAAAGCTTAACCGCCCCGCCGCCCAGCCCCACCTCCGACGCCGCGGCCCCAGACATGCAAGAGATGGAGGAA
TCCATCGAGATTGACCTGGGCTACGTGACGCCCGCGGAGCACGAGGAGGAGCTGGCAGCGCGCTTTTCAGCCCGGAAGAGA
ACCACCAAGAGCAGCCAGAGCAGGAAGCAGAGAACGAGCAGAACCAGGCTGGGCACGAGCATGGCGACTACCTGAGCGGG
GCAGAGGACGTGCTCATCAAGCATCTGGCCCGCCAATGCATCATCGTCAAGGACGCGCTGCTCGACCGCGCCGAGGTGCCCCT
```

Fig. 24G

```
CAGCGTGGCGGAGCTCAGCCGCGCCTACGAGCGCAACCTCTTCTCGCCGCGCGTGCCCCCCAAGCGCCAGCCCAACGGCACCT
GTGAGCCCAACCCGCGCCTCAACTTCTACCCGGTCTTCGCGGTGCCCGAGGCCCTGGCCACCTACCACCTCTTTTTCAAGAACC
AAAGGATCCCCGTCTCCTGCCGCGCCAACCGCACCCGCGCCGACGCCCTGCTCAACCTGGGCCCCGGCGCCCGCCTACCTGAT
ATCACCTCCTTGGAAGAGGTTCCCAAGATCTTCGAGGGTCTGGGCAGCGACGAGACTCGGGCCGCGAACGCTCTGCAAGGAA
GCGGAGAGGAGCATGAGCACCACAGCGCCCTGGTGGAGTTGGAAGGCGACAACGCGCGCCTGGCGGTCCTCAAGCGCACGG
TCGAGCTGACCCACTTCGCCTACCCGGCGCTCAACCTGCCCCCCAAGGTCATGAGCGCCGTCATGGACCAGGTGCTCATCAAG
CGCGCCTCGCCCCTCTCGGAGGAGGAGATGCAGGACCCCGAGAGTTCGGACGAGGGCAAGCCCGTGGTCAGCGACGAGCAG
CTGGCGCGCTGGCTGGGAGCGAGTAGCACCCCCAGAGCCTGGAAGAGCGGCGCAAGCTCATGATGGCCGTGGTCCTGGTG
ACCGTGGAGCTGGAGTGTCTGCGCCGCTTCTTTGCCGACGCGGAGACCCTGCGCAAGGTCGAGGAGAACCTGCACTACCTCTT
CAGGCACGGGTTCGTGCGCCAGGCCTGCAAGATCTCCAACGTGGAGCTGACCAACCTGGTCTCCTACATGGGCATCCTGCACG
AGAACCGCCTGGGGCAAAACGTGCTGCACACCACCCTGCGCGGGGAGGCCCGCCGCGACTACATCCGCGACTGCGTCTACCT
GTACCTCTGCCACACCTGGCAGACGGGCATGGGCGTGTGGCAGCAGTGCCTGGAGGAGCAGAACCTGAAAGAGCTCTGCAA
GCTCCTGCAGAAGAACCTCAAGGCCCTGTGGACCGGGTTCGACGAGCGTACCACCGCCTCGGACCTGGCCGACCTCATCTTCC
CCGAGCGCCTGCGGCTGACGCTGCGCAACGGGCTGCCCGACTTTATGAGCCAAAGCATGTTGCAAAACTTTCGCTCTTTCATCC
TCGAACGCTCCGGGATCCTGCCCGCCACCTGCTCCGCGCTGCCCTCGGACTTCGTGCCGCTGACCTTCCGCGAGTGCCCCCCGC
CGCTCTGGAGCCACTGCTACTTGCTGCGCCTGGCCAACTACCTGGCCTACCACTCGGACGTGATCGAGGACGTCAGCGGCGAG
GGTCTGCTGGAGTGCCACTGCCGCTGCAACCTCTGCACGCCGCACCGCTCCCTGGCCTGCAACCCCCAGCTGCTGAGCGAGAC
CCAGATCATCGGCACCTTCGAGTTGCAAGGCCCCGGCGACGGCGAGGGCAAGGGGGGTCTGAAACTCACCCCGGGGCTGTG
GACCTCGGCCTACTTGCGCAAGTTCGTGCCCGAGGACTACCATCCCTTCGAGATCAGGTTCTACGAGGACCAATCCCAGCCGCC
CAAGGCCGAGCTGTCGGCCTGCGTCATCACCCAGGGGGCCATCCTGGCCCAATTGCAAGCCATCCAGAAATCCCGCCAAGAAT
TTCTGCTGAAAAAGGGCCACGGGGTCTACTTGGACCCCCAGACCGGAGAGGAGCTCAACCCCAGCTTCCCCCAGGATGCCCCG
AGGAAGCAGCAAGAAGCTGAAAGTGGAGCTGCCGCCGCCGGAGGATTTGGAGGAAGACTGGGAGAGCAGTCAGGCAGAGG
AGGAGGAGATGGAAGACTGGGACAGCACTCAGGCAGAGGAGGACAGCCTGCAAGACAGTCTGGAGGAGGAAGACGAGGT
GGAGGAGGCAGAGGAAGAAGCAGCCGCCGCCAGACCGTCGTCCTCGGCGGAGAAAGCAAGCAGCACGGATACCATCTCCGC
TCCGGGTCGGGGTCGCGGCGGCCGGGCCCACAGTAGGTGGGACGAGACCGGGCGCTTCCCGAACCCCACCACCCAGACCGG
TAAGAAGGAGCGGCAGGGATACAAGTCCTGGCGGGGGCACAAAAACGCCATCGTCTCCTGCTTGCAAGCCTGCGGGGGCAA
CATCTCCTTCACCCGGCGCTACCTGCTCTTCCACCGCGGGGTGAACTTCCCCCGCAACATCTTGCATTACTACCGTCACCTCCAC
AGCCCCTACTACTGTTTCCAAGAAGAGGCAGAAACCCAGCAGCAGCAGAAAACCAGCGGCAGCAGCAGCTAGAAAATCCACA
GCGGCGGCAGGTGGACTGAGGATCGCGGCGAACGAGCCGGCGCAGACCCGGGAGCTGAGGAACCGGATCTTTCCCACCCTC
TATGCCATCTTCCAGCAGAGTCGGGGGCAGGAGCAGGAACTGAAAGTCAAGAACCGTTCTCTGCGCTCGCTCACCCGCAGTTG
TCTGTATCACAAGAGCGAAGACCAACTTCAGCGCACTCTCGAGGACGCCGAGGCTCTCTTCAACAAGTACTGCGCGCTCACTCT
TAAAGAGTAGCCCGCGCCCCGCCCACACACGGAAAAAGGCGGGAATTACGTCACCACCTGCGCCCCTTCGCCCGACCATCATGAG
CAAAGAGATTCCCACGCCTTACATGTGGAGCTACCAGCCCCAGATGGGCCTGGCCGCCGGCGCCGCCCAGGACTACTCCACCC
GCATGAACTGGCTCAGTGCCGGGCCCGCGATGATCTCACGGGTGAATGACATCCGCGCCCACCGAAACCAGATACTCCTAGAA
CAGTCAGCGATCACCGCCACGCCCCGCCATCACCTTAATCCGCGTAATTGGCCCGCCGCCCTGGTGTACCAGGAAATTCCCCAG
CCCACGACCGTACTACTTCCGCGAGACGCCCAGGCCGAAGTCCAGCTGACTAACTCAGGTGTCCAGCTGGCCGGCGGCGCCGC
CCTGTGTCGTCACCGCCCCGCTCAGGGTATAAAGCGGCTGGTGATCCGAGGCAGAGGCACACAGCTCAACGACGAGGTGGTG
AGCTCTTCGCTGGGTCTGCGACCTGACGGAGTCTTCCAACTCGCCGGATCGGGGAGATCTTCCTTCACGCCTCGTCAGGCCGTC
CTGACTTTGGAGAGTTCGTCCTCGCAGCCCCGCTCGGGCGGCATCGGCACTCTCCAGTTCGTGGAGGAGTTCACTCCCTCGGTC
TACTTCAACCCCTTCTCCGGCTCCCCCGGCCACTACCGGACGAGTTCATCCCGAACTTCGACGCCATCAGCGAGTCGGTGGAC
GGCTACGATTGAATGTCCCATGGTGGCGCAGCTGACCTAGCTCGGCTTCGACACCTGGACCACTGCCGCCGCTTCCGCTGCTTC
GCTCGGGATCTCGCCGAGTTTGCCTACTTTGAGCTGCCCGAGGAGCACCCTCAGGGCCCAGCCCACGGAGTGCGGATCATCGT
CGAAGGGGCCTCGACTCCCACCTGCTTCGGATCTTCAGCCAGCGACCGATCCTGGTCGAGCGCGAACAAGGACAGACCCTTC
TTACTTTGTACTGCATCTGCAACCACCCCGGCCTGCATGAAAGTCTTTGTTGTCTGCTGTGTACTGAGTATAATAAAGCTGAGA
TCAGCGACTACTCCGGACTCGATTGTGGTGTTCCTGCTATCAACCGGTCCCTGTTCTTCACCGGGAACGAGACCGAGCTCCAGC
TCCAGTGTAAGCCCCACAAGAAGTACCTCACCTGGCTGTTCCAGGGCTCCCCGATCGCCGTTGTCAACCACTGCGACAACGAC
GGAGTCCTGCTGAGCGGCCCTGCCAACCTTACTTTTTCCACCCGCAGAAGCAAGCTCCAGCTCTTCCAACCCTTCCTCCCCGGG
ACCTATCAGTGCGTCTCAGGACCCTGCCATCACACCTTCCACCTGATCCCGAATACCACAGCGCCGCTCCCCGCTACTAACAACC
AAACTACCCACCAACGCCACCGTCGCGACCTTTCCTCTGAATCTAATACCACTACCGGAGGTGGCTTCTGCTGTTAGTGCTCCCC
CGTCCCGTCGACCCCCGGTCCCCCACTCAGTCCCCGAGGAGGTTCGCAAATGCAAATTCCAAGAACCCTGGAAATTCCTCAAA
TGCTACCGCCAAAAATCAGACATGCATCCCAGCTGGATCATGATCATTGGGATCGTGAACATTCTGGCCTGCACCCTCATCTCC
```

Fig. 24H

```
TTTGTGATTTACCCCTGCTTTGACTTTGGTTGGAACTCGCCAGAGGCGCTCTATCTCCCGCCTGAACCTGACACACCACCACAGC
AGCAACCTCAGGCACACGCACTACCACCACCACAGCCTAGGCCACAATACATGCCCATATTAGACTATGAGGCCGAGCCACAG
CGACCCATGCTCCCCGCTATTAGTTACTTCAATCTAACCGGCGGAGATGACTGACCCACTGGCCAATAACAACGTCAACGACCT
TCTCCTGGACATGGACGGCCGCGCCTCGGAGCAGCGACTCGCCCAACTTCGCATTCGTCAGCAGCAGGAGAGAGCCGTCAAG
GAGCTGCAGGACGGCATAGCCATCCACCAGTGCAAGAGAGGCATCTTCTGCCTGGTGAAACAGGCCAAGATCTCCTACGAGG
TCACCCAGACCGACCATCGCCTCTCCTACGAGCTCCTGCAGCAGCGCCAGAAGTTCACCTGCCTGGTCGGAGTCAACCCCATCG
TCATCACCCAGCAGTCGGGCGATACCAAGGGGTGCATCCACTGCTCCTGCGACTCCCCGACTGCGTCCACACTCTGATCAAGA
CCCTCTGCGGCCTCCGCGACCTCCTCCCCATGAACTAATCACCCCCTTATCCAGTGAAATAAAGATCATATTGATGATGATTTAA
ATAAAAAAAATAATCATTTGATTTGAAATAAAGATACAATCATATTGATGATTTGAGTTTAACAAAAATAAAGAATCACTTACTT
GAAATCTGATACCAGGTCTCTGTCCATGTTTTCTGCCAACACCACCTCACTCCCCTCTTCCCAGCTCTGGTACTGCAGGCCCCGG
CGGGCTGCAAACTTCCTCCACACGCTGAAGGGGATGTCAAATTCCTCCTGTCCCTCAATCTTCATTTTATCTTCTATCAGATGTC
CAAAAAGCGCGTCCGGGTGGATGATGACTTCGACCCCGTCTACCCCTACGATGCAGACAACGCACCGACCGTGCCCTTCATCA
ACCCCCCCTTCGTCTCTTCAGATGGATTCCAAGAGAAGCCCCTGGGGGTGTTGTCCCTGCGACTGGCTGACCCCGTCACCACCA
AGAACGGGGAAATCACCCTCAAGCTGGGAGAGGGGGTGGACCTCGACTCGTCGGGAAAACTCATCTCCAACACGGCCACCAA
GGCCGCCGCCCTCTCAGTATTTCAAACAACACCATTTCCCTTAAAACTGCTGCCCCTTTCTACAACAACAATGGAACTTTAAGC
CTCAATGTCTCCACACCATTAGCAGTATTTCCCACATTTAACACTTTAGGCATAAGTCTTGGAAACGGTCTTCAGACTTCAAATA
AGTTGTTGACTGTACAACTAACTCATCCTCTTACATTCAGCTCAAATAGCATCACAGTAAAAACAGACAAAGGGCTATATATTA
ACTCCAGTGGAAACAGAGGACTTGAGGCTAATATAAGCCTAAAAAGAGGACTAGTTTTTGACGGTAATGCTATTGCAACATAT
ATTGGAAATGGCTTAGACTATGGATCTTATGATAGTGATGGAAAAACAAGACCCGTAATTACCAAAATTGGAGCAGGATTAAA
TTTTGATGCTAACAAAGCAATAGCTGTCAAACTAGGCACAGGTTTAAGTTTTGACTCCGCTGGTGCCTTGACAGCTGGAAACAA
ACAGGATGACAAGCTAACACTTTGGACTACCCCTGACCCAAGCCCTAATTGTCAATTACTTTCAGACAGAGATGCCAAATTTAC
TCTCTGTCTTACAAAATGCGGTAGTCAAATACTAGGCACTGTGGCAGTGGCGGCTGTTACTGTAGGATCAGCACTAAATCCAAT
TAATGACACAGTCAAAAGCGCCATAGTTTTCCTTAGATTTGATTCCGATGGTGTACTCATGTCAAACTCATCAATGGTAGGTGA
TTACTGGAACTTTAGGGAGGGACAGACCACTCAAAGTGTAGCCTATACAAATGCTGTGGGATTCATGCCAAATATAGGTGCAT
ATCCAAAAACCCAAAGTAAAACACCTAAAAATAGCATAGTCAGTCAGGTATATTTAACTGGAGAAACTACTATGCCAATGACA
CTAACCATAACTTTCAATGGCACTGATGAAAAAGACACAACCCCAGTTAGCACCTACTCTATGACTTTTACATGGCAGTGGACT
GGAGACTATAAGGACAAAAATATTACCTTTGCTACCAACTCATTCTCTTTTTCCTACATCGCCCAGGAATAATCCCACCCAGCAA
GCCAACCCCTTTTCCCACCACCTTTGTCTATATGGAAACTCTGAAACAGAAAAATAAAGTTCAAGTGTTTTATTGAATCAACAGT
TTTACAGGACTCGAGCAGTTATTTTTCCTCCACCCTCCCAGGACATGGAATACACCACCCTCTCCCCCCGCACAGCCTTGAACAT
CTGAATGCCATTGGTGATGGACATGCTTTTGGTCTCCACGTTCCACACAGTTTCAGAGCGAGCCAGTCTCGGATCGGTCAGGG
AGATGAAACCCTCCGGGCACTCCCGCATCTGCACCTCACAGCTCAACAGCTGAGGATTGTCCTCGGTGGTCGGGATCACGGTT
ATCTGGAAGAAGCAGAAGAGCGGCGGTGGGAATCATAGTCCGCGAACGGGATCGGCCGGTGGTGTCGCATCAGGCCCCGCA
GCAGTCGCTGCCGCCGCCGCTCCGTCAAGCTGCTGCTCAGGGGGTTCGGGTCCAGGGACTCCCTCAGCATGATGCCCACGGCC
CTCAGCATCAGTCGTCTGGTGCGGCGGGCGCAGCAGCGCATGCGAATCTCGCTCAGGTCACTGCAGTACGTGCAACACAGGA
CCACCAGGTTGTTCAACAGTCCATAGTTCAACACGCTCCAGCCGAAACTCATCGCGGGAAGGATGCTACCCACGTGGCCGTCG
TACCAGATCCTCAGGTAAATCAAGTGGCGCTCCCTCCAGAAGACGCTGCCCATGTACATGATCTCCTTGGGCATGTGCGGTTC
ACCACCTCCCGGTACCACATCACCCTCTGGTTGAACATGCAGCCCCGGATGATCCTGCGGAACCACAGGGCCAGCACCGCCCC
GCCCGCCATGCAGCGAAGAGACCCCGGATCCCGGCAATGACAATGGAGGACCCACCGCTCGTACCCGTGGATCATCTGGGAG
CTGAACAAGTCTATGTTGGCACAGCACAGGCATATGCTCATGCATCTCTTCAGCACTCTCAGCTCCTCGGGGGTCAAAACCATA
TCCCAGGGCACGGGGAACTCTTGCAGGACAGCGAACCCCGCAGAACAGGGCAATCCTCGCACATAACTTACATTGTGCATGG
ACAGGGTATCGCAATCAGGCAGCACCGGGTGATCCTCCACCAGAGAAGCGCGGGTCTCGGTCTCCTCACAGCGTGGTAAGGG
GGCCGGCCGATACGGGTGATGGCGGGACGCGGCTGATCGTGTTCTCGACCGTGTCATGATGCAGTTGCTTTCGGACATTTTCG
TACTTGCTGTAGCAGAACCTGGTCCGGGCGCTGCACACCGATCGCCGGCGGCGGTCTCGGCGCTTGGAACGCTCGGTGTTAA
AGTTGTAAAACAGCCACTCTCTCAGACCGTGCAGCAGATCTAGGGCCTCAGGAGTGATGAAGATCCCATCATGCTGATAGCT
CTGATCACATCGACCACCGTGGAATGGGCCAGGCCCAGCCAGATGATGCAATTTTGTTGGGTTTCGGTGACGGCGGGGGAGG
GAAGAACAGGAAGAACCATGATTAACTTTTAATCCAAACGGTCTCGGAGCACTTCAAAATGAAGGTCACGGAGATGGCACCTC
TCGCCCCCGCTGTGTTGGTGGAAAATAACAGCCAGGTCAAAGGTGATACGGTTCTCGAGATGTTCCACGGTGGCTTCCAGCAA
AGCCTCCACGCGCACATCCAGAAACAAGACAATAGCGAAAGCGGGAGGGTTCTCTAATTCCTCAACCATCATGTTACACTCCTG
CACCATCCCCAGATAATTTTCATTTTTCCAGCCTTGAATGATTCGAACTAGTTCCTGAGGTAAATCCAAGCCAGCCATGATAAAA
AGCTCGCGCAGAGCACCCTCCACCGGCATTCTTAAGCACACCCTCATAATTCCAAGATATTCTGCTCCTGGTTCACCTGCAGCA
GATTGACAAGCGGAATATCAAAATCTCTGCCGCGATCCCTGAGCTCCTCCCTCAGCAATAACTGTAAGTACTCTTTCATATCGTC
TCCGAAATTTTTAGCCATAGGACCCCCAGGAATAAGAGAAGGGCAAGCCACATTACAGATAAACCGAAGTCCCCCCCAGTGAG
CATTGCCAAATGTAAGATTGAAATAAGCATGCTGGCTAGACCCGGTGATATCTTCCAGATAACTGGACAGAAAATCGGGTAAG
CAATTTTTAAGAAAATCAACAAAAGAAAATCTTCCAGGTGCACGTTTAGGGCCTCGGGAACAACGATGGAGTAAGTGCAAG
GGGTGCGTTCCAGCATGGTTAGTTAGCTGATCTGTAAAAAACAAAAAATAAAACATTAAACCATGCTAGCCTGGCGAACAGG
TGGGTAAATCGTTCTCTCCAGCACCAGGCAGGCCACGGGGTCTCCGGCGCGACCCTCGTAAAATTGTCGCTATGATTGAAAA
CCATCACAGAGAGACGTTCCCGGTGGCCGGCGTGAATGATTCGAAGAAGCATACACCCCCGGAACATTGGAGTCCGTGAG
TGAAAAAAAGCGGCCAGGAAGCAATGAGGCACTACAACCTCACTCTCAAGTCCAGCAAAGCGATGCCATGCGGATGAAGC
ACAAAATTTTCAGGTGCGTAAAAAATGTAATTACTCCCCTCCTGCACAGGCAGGCGAAGCTCCCGATCCTCCAGATACACATAC
AAAGCCTCAGCGTCCATAGCTTACCGAGCGGCAGCAGCAGCGGCACACAACAGGCGCAAGAGTCAGAGAAAAGACTGAGCT
CTAACCTGTCCGCCCGCTCTCTGCTCAATATATAGCCCCAGATCTACACTGACGTAAAGGCCAAAGTCTAAAAATACCCGCCAA
ATAATCACACACGCCCAGCACACGCCCAGAAACCGGTGACACACTCAGAAAAATACGCGCACTTCCTCAAACGGCCAAACTGC
CGTCATTTCCGGGTTCCCACGCTACGTCATCAAAACACGACTTTCAAATTCCGTCGACCGTTAAAAACATCACCCGCCCCGCCCC
TAACGGTCGCCGCTCCCGCAGCCAATCACCTTCCTCCCTCCCCAAATTCAAACAGCTCATTTGCATATTAACGCGCACCAAAAGT
TTGAGGTATATTATTGATGATG
```

Fig. 24I

AdC6 020-DU172gp160(E1620) Amino acids – SEQ ID NO: 13
**The symbol " * " refers herein to stop codons in the non coding regions**

HHQ*YTSNFWCALICK*AV*IWGGRKVIGCGSGDR*GRGG*RFDDVAMRRSRFASSRGKSDVKRGVV*TRKYSIFPRSLTGNEVFL
GGCK*KRAIFARKLNEEVKI*VISRLWQGGVFAEGRVDFDRLGGFDYRIFHLNFRVRCQSPVFLRTISFPRKCHLTVTITVLR*RKLRS
PDPLWCTLSTICSDAA*LSQYLLPACVLEVAE*CASKI*ATTRQGLTDNCMKNLLRVRRFALLRDVRARYTR*H*LLTSMPSTPPIDVN
DGKWPAWHYAQYMTLWDFPTWQYIYVLVIAITMVMRFWQYINGRG*RFDSRGFPSLHPIDVNGSLFWHQNQRDFPKCRNNSA
PLTQMGGRRVRWEVYISRARLVNRQITRSFIAVVYHS*IANAVSASDTTVSNLRLEYLIRLTIG*LRLEFDATMRVMGILRSYQQWWI
WGILGFWMLMICNVWGNLWVTVYYGVPVWKEAKTTLFCASDAKAHKEEVHNIWATHACVPTDPNPQEIVLKNVTENFNMWK
NDMVDQMHEDIISLWDQSLKPCVKLTPLCVTLNCSDVKIKGTNATYNNATYNNNNTISDMKNCSFNTTTEITDKKKKEYALFYKLDV
VALDGKETNSTNSSEYRLINCNTSAVTQACPKVSFDPIPIHYCAPAGYAILKCNNKTFNGTGPCNNVSTVQCTHGIKPVVSTQLLLNG
SLAEEEVVIRFENLTNNAKIIVHLNESVEINCTRPSNNTRKSVRIGPGQTFFATGDIIGDIRQAHCNISRKKWNTTLQRVKEKLKEKFPN
KTIQFAPSSGGDLEITTHSFNCRGEFFYCYTSDLFNSTYMSNNTGGANITLQCRIKQIIRMWQGVGQAMYAPPIAGNITCKSNITGLL
LTRDGGKEKNDTETFRPGGGDMRDNWRSELYKYKVVEIKPLGIAPDKAKRRVVEREKRAVGIGAVFLGFLGAAGSTMGAASMTLT
VQARQLLSGIVQQQSNLLRAIEAQQHMLQLTVWGIKQLQTRVLAIERYLKDQQLLGIWGCSGKLICTTAVPWNASWSNKSYEEIW
GNMTWMQWDREINNYTNTIYSLLEESQNQQEKNEKDLLALDSWESLWSWFNITNWLWYIRIFIIVGGLIGLRIIFAVLSIVNRVRQ
GYSPLSFQTLTPSPREPDRLGRIEEEGGEQDRARSVRLVNGFLALAWEDLRSLCLFSYHRLRDLILIAARAAALLGRSSLWGLQKGWE
ALKYLGSLVQYWGLELKKSAISLFDAIAITVAEGTDRIINIVQRISRAFYNIPRRIRQGFEATLQ*GTSRVDPGGQTADQPRLCLLVASHL
LFAPPPCLP*PWKVPLPLSFPNKMRKLHRIV*VGVILFWGVGWGRTARGRIGKTIAGMLGMRWALWLLRRKEPADLQI*IHLCRVR
RKRNGIMGIMGLHIGQISTYAGHRACGLAPPQDMARVRAQRHDPLQCAPGLPPRHVHALPVQHAICEGAAGARCHVQSEP
DGGV*HECGAVENSEI**IQDQVPGLRMRRQARQASARVCGGDGGPATRSFGVVLQRDGVRLQRGRI*LE*VVFGAGCEPA*GA
E*LKSVVFCVLQQHERKRLL*GRGIQPLSDGASPLLGGSASECDGIHGGRPARAARELFNPDLRDPELLVRGRSCRRSCCFRRQRRAR
NGPGRRLLQLSGGQLEFHQ*SRQPERGEAAAADGPARGPDPAPGRADPAGGSAAGGDAGRGCHGENQIKNESINKRRRLLILTQS
LESLFDFSRAVGPPPVSIIEHPVDLFQDPVEVGLDVEVHGHEPVPGVEVAPLQGLVLGDGVVNHPVIAGAQGVVLHDVLEEETDG
HGQPLGVGVDEPVELGGMHAGGDEMHLGLDLEIGDVPAQIPPGVHVVQDHQHGVSGALGEFVMQLGREGVKEFGDALVTAQV
FHALIHDDGDGPVGGGLGKDVSGVGHIVVVVLGELVIGHFNEFGAEGARLGDEGALDPGGVVALADLHLPGLELGGGDHVHLRGD
EKNGFRGGGDELGRKQVPEQLGLAATGGAVDDPDDRLQVVVEGETAAVLAEEGGHLVHHLAHMHVLAHEFRQEALAPQREELL
QRGEVFQRLESVGHGHFGEGLLQEFQTVPELGDVL*GISIQQTSSFRGLGRLRE*GTRRWASSEARVRSFQGRRVRVSVVSVTVKGC
APGWALARVRFRLIRLVENRSRSAPCASAR*QLSMSS*LSASAAWPLARSLPLEVCPQTGQRRDLRA*SLGARKTDSGA*ASAPQLA
QTVSHSTSQVRSGRLGSKTRFPPCFLMRFLPLVSMSSCPRWVTKRLSVSP*TDFMGRSSSGVPRSSS*RNPAHSETKARVQASTKEA
TWEG*RSLSTSGSTFSRVCKHMSPSSTSRKVIGL*V*AT*PGVPAGGV*KGAGPCSSSLSSGSLSRSASCWGRYSLSKAGMTSALRLS
VSRNEEDLILTVPLETPFMSPSSIWSEKTIFLLSSLVAKEP*RALESSLAMERMVWFFSLSARSLAAMLSCTYSRATHFHSGKTVVSSSG
TILTRQPRLCRVMRSTLVATSPRRGSLVQQRRPPLREQKGGSGSSMSSSGGSASTVKMPGRSSGSK*LMQVPRLSSAACQSRTASA
RS*GLRGVPQGMGCVSAEAYMPQMS*T*RGSSRTPM*VG*QRPPRMLART*SYSSCEGARSPVPRLERCGFSAR*TIWRKMAW
ELEEMVGLWKMLKWAWGRPTESLMKWA*ESCSLATSSAVTRTSRAQ*SRVSWMMSYLSWPFCFHSSRLRRNSSRSFQYSSRGN
PS*SAR*EPTM*NWLTAL*AQQPFSTGRA*ACAALRREVWVRAKVSRTMTLRNWCLKSRSSQPPCSQSWKSVRFL*AGLGKAKVT
SLKRILPARGMKLRVMRKGWGTSARLLMTWAARTISSKPLMLCPTM*SSTNRGRPLTWGSFLSSS*VSSAGSLSPCCSRAQSATW
GLALRKEVQRSTARAVCKRSRY*RNCWPTAIFSGVTQ*KVRGSPCQRSHLSWRARSWASSTSGGSPESFMTSMKGTSCLPKDPIQV
*VSTS*VRKSLSVRGCEPMGKNWISCHQLEEWLLM*WK*KCRRRAEHSCLCLYKRPQCSQRCTGCTCCTSCTWVPLARNFSGQW
SAGGCISCCTTSWPSAWPSSASMVVMLTSPRGRQVQTSARTGRRARTRARRPELSRVLRRCGVRSVGSGGARLTCRSFSRARGRSR
WYLISTAPLVATSTACRVPCPWGATTVPRFFLGAASMSVRSGGEDARRAAGAARGPEAGAAGARRRRARAGSGTAPGEDWRERR
RDG*RPGSDASG*RPRDP*V*T*KRVRQNQSRYR*RRPAAGSLARRPSCPGRRSRS*TARSPPPEGLRGRRARRWPRGRWRCGP*
AARRRSCRPRSRRGCRPRLRRGRARA*PPGRG*ARRGA*RPRSCRGAGRGS*AWWRCAR*RRST*SSGGAASR*RRPGLPSVPW
PRRSPRRS*KTGSCAPRRSTPPPEDG*ARRWWRAPRARRPRGAPLPSPPLPPPLTSLLLPPQEAVAGEGPCVAGGARADGR*SAR
WSPRAGDAWSR*RRARPRGAAA*RRRRASPGGRRGGLRWAGRGR*RCILSIDP*GLRART*ASRDPRDPKTAERRLRASRSRKVG
*ARFLVLRVFGREAGGRCCW**S*SRRS*DGGWWRGAPGPWARLAGCADGRPCPRRGPDTWRGPCSSPA*AAPRAPPPRPRGR
ACA*ARTRAAAGRAPGRRRRAR*GWPAGSG*GWSGSRRSRRSGGRLRC*WCRSSWP*RTS*RSGGRVARARGT*GASRRACRR
CSRCRRARGTGIRRGSAAAAGGRAAIARWRGRRARGPRA*GGGSRRCTWTSR*CRRRWWRRAGTRGRGSRCCAAAGSSSWWP
RSGP*GARSRGCSRHTGKNESGQRLDSVAWRLSERVGLRVYPGSNLESGWSRS*RGTGTPVSTQAC*RNLQDTEAGRFLALVAGH
EKLVSAESGRPRWLAAVVWRKNRQGCVAVCPGSSLSARRRPDSAANVGVAAPSFPRPLSQPTSPVTERAPLFFSCVFARCIPYCGRC
APTLHHNRPYRSSSNSRRFCPRPSSSQPLPRRPP*AEPAFSMTWPWKRARGWRGWGRRRSGTRACR*KGTLARPTCPSRTCSET

Fig. 24J

GAARSPRRCAPPASTRGGSCGAAWTESGC*GTRISRRTS*RGSAPRARTWPRPTWSRRTSRP*RRRATSKNPSTTTCAR*SRARR*
PWA*CTCGTCWRPSCRTPRASR*RRSCFWWCSTVGTTRRSGRRC*ISPSPRAAGSWTW*TFCRASWCRSAGCRCPRSWRPSTSR
C*VWASTTLGRSTRPRTCP*TRR*RSTGFTCA*P*KC*P*ATIWGCTATTGCTAR*APAAGAS*ATRS*CTACSGP*PGPGPRGRAT
LTWARTCAGSPAAGPWKLPAVPPTWRRWTMRRRRASTWKTDGATVFLLDAATATAAAS*SRDAGGAAEPAVRH*LLGRLDPGH
ATHHGADDPQSRSL*TAASGQPALGHPGGRGALALEPHAREGAGHRERAGGEQGHPR*RGRAGVQRAAGARGPLQQHQRADE
PGPHGDRRARGGVAARAVPPRVEPGLHGGAERLPEHAARQRAPGPGGLHQLHQRAAADGGRGAPERGVPVGAGLLLPDQSPGL
ADREPEPGFQELAGTVGRAGPGRGPRDGVEPADAELAPAAAAGGALHGQRQREPRLVPGLPA*PVPRGHRTGARGRADLPGDH
PREPRAGPGGPGQPGGHPELPADQPVAEDPAPVRAEHRGGAHPALRAAERGAVPDAGGGHAQRGARHDRAQHGAQHVRPQP
PVHQ*ADGLLASGGRHELGLLYQRHLEPALAPAARVLHGRVRHARPQRRVPVGRRGQQRVLAASRNQCRVEERGRGPAAVLGAV
RSRGCCRGGARGRQPLPEPALFAEQRAQQRAGSADATAPAGRGGVPERLLVEARAREELPQ*RDREPGGQDEPLEDVRARAQGR
APS*QRRHP*TPAARQAAGTGVGR*GFRRRQQRVGLGWEWW*PVRSPAPPYRAPDVRI*KNKRRYSPRPWRPACVLLCCL**YD
EARVPGGSSSLVRERDAAGGGGGDAAPAGGALRAPAVPGAYGGAEQHSLLGAGTLVRYHPVVPGGQQVGRHRLAELPERPQQLP
DHRGAEQRFHPHGGQHPDHQL*RALAVGRPAENHHAHQHAQRERVHVQQQVQGAGDGLAQDPQRGG**L*W*SGRADLRV
GGV*AARGQLLGDHDHRSDEQRHHRQLLGGGAAERGAGERHRREVRHAQLPAGLGPRDRAGDAGRVHQRGLPPRHRPAARLR
RGLHREPPQQPAGHPQAAALPGGLPDPVRGPGGGQHPRALGCRSLREKQGG*HRRGDRSRGHRLYRGAGR*FC*RCGSGRGG*
NRK*DSHPAGGEGQQGQELQRARGQEKHRLPQLVPGLQLRRPREGRALLDAAHHLGRHLRRGASLLVAARHDARPGHLPLHASS
*QLPGGGRRAPARLLQELLQRAGRLLAAAARLHLAHARLQPLPREPDPRPPARAHHYHRQ*KRSCSHRSRDPAAAQQYPGSPARD
RH*RQTPHLPLRLQGPGRSRAARPLEPHLLKNVHSHLAQ**HRLGPARAQQDVRRRSPTLHATPRARARALPRSLGRPQGPRALAH
HRRRRDRPGGGRRAQLHARRRARLHRGRRHRQRGGRRAPVRPHQEPAAAHRPAAPEHPRHARGASLAAQGQAHGTQGHAQG
GQTRGLRQQQRRQDPQTRGHGGGGGHRQHVPPAARQRVLGARRRHRCARARAHPPPSHLKMLTSRC*CVPAARRMSKRKYKE
EMLQVIAPEIYGPAAAVKEERKPRKLKRVKKDKKEEEDDGLVEFVREFAPRRRVQWRGRKVKPVLRPGTTVVFTPGERSGSASKRSY
DEVYGDEDILEQAVERLGEFAYGKRSRPAPLKEEAVSIPLDHGNPTPSLKPVTLQQVLPSAAPRRGFKREGGEDLYPTMQLMVPKRQ
KLEDVLEHMKVDPEVQPEVKVRPIKQVAPGLGVQTVDIKIPTEPMETQTEPVKPSTSTMEVQTDPWMPAPASTSTRRRRKYGAASL
LMPNYALHPSIIPTPGYRGTRFYRGYTSSRRRKTTTRRRRRSRRSSTATSALVRRVYRSGREPLTLPRARYHPSIAI*LPPPTCRYGPHM
PPPPRPHYGLPRKKAAP*KADGERAASPSPPAAARHQQAVGGRLPARADPHHRRGDRGDPRHSFRGGAGLSAPLRHKKAWICNKK
KNGLTLLVL*CVFLDGRHQFFVPGTATRHAAVYGHLERHRQQPTERGRLQLEQSLERA*EFRVHAQNLWQQGVEQQHRAGAEGK
AERTELPAEGG*WPGLRHQRGG*PGQPGRAETDQQPPGRGPARGVRGDAPGGGGAASPGQARRQATASRRGGDAADAHGRA
APVRGGGETGPAHHAARGASGHRSAETQQQPARDPGLASASPLHSG*APAAGGRRVARPPRPPPGELAEHSEQHRGSGSAECEA
PPLLLKDTVALNLLVCVYMYVRRPEGGV*RGASPSCKMATPSMLPQWAYMHIAGQDASEYLSPGLVQFARATDTYFSLGNKFRNP
TVAPTHDVTTDRSQRLTLRFVPVDREDNTYSYKVRYTLAVGDNRVLDMASTYFDIRGVLDRGPSFKPYSGTAYNSLAPKGAPNSSQ
WEQAKTGNGGTMETHTYGVAPMGGENITKDGLQIGTDVTANQNKPIYADKTFQPEPQVGEENWQETENFYGGRALKKDTNMK
PCYGSYARPTNEKGGQAKLKVGDDGVPTKEFDIDLAFFDTPGGTVNGQDEYKADIVMYTENTYLETPDTHVVYKPGKDDASSEINL
VQQSMPNRPNYIGFRDNFIGLMYYNSTGNMGVLAGQASQLNAVVDLQDRNTELSYQLLLDSLGDRTRYFSMWNQAVDSYDPDV
RIIENHGVEDELPNYCFPLDGSGTNAAYQGVKVKDGQDGVESEWENDDTVAARNQLCKGNIFAMEINLQANLWRSFLYSNVALY
LPDSYKYTPTNVTLPTNTNTYDYMNGRVTPPSLVDAYLNIGARWSLDPMDNVNPFNHHRNAGLRYRSMLLGNGRYVPFHIQVPQ
KFFAIKSLLLLPGSYTYEWNFRKDVNMILQSSLGNDLRTDGASIAFTSINLYATFFPMAHNTASTLEAMLRNDTNDQSFNDYLSAAN
MLYPIPANATNVPISIPSRNWAAFRGWSFTRLKTRETPSLGSGFDPYFVYSGSIPYLDGTFYLNHTFKKVSITFDSSVSWPGNDRLLTP
NEFEIKRTVDGEGYNVAQCNMTKDWFLVQMLAHYNIGYQGFYVPEGYKDRMYSFFRNFQPMSRQVVDEVNYKDYQAVTLAYQH
NNSGFVGYLAPTMRQGQPYPANYPYPLIGKSAVASVTQKKFLCDRVMWRIPFSSNFMSMGALTDLGQNMLYANSAHALDMNFE
VDPMDESTLLYVVFEVFDVVRVHQPHRGVIEAVYLRTPFSAGNATT*AALASCKMTAGSGEQELRAILRDLGCGPCFLGTFDKRFPG
FMAPHKLACAIVNTAGRETGGEHWLAFAWNPRSHTCYLFDPFGFSDERLKQIYQFEYEGLLRRSALATEDRCVTLEKSTQTVQGPRS
AACGLFCCMFLHAFVHWPDRPMDKNPTMNLLTGVPNGMLQSPQVEPTLRRNQEALYRFLNAHSAYFRSHRARIEKATAFDRMN
QDM*KTGVCM*MLYS**TAHVYATFSEALTLFRNRRGSAGSRHGPRAGIRCGTGTWAAT*TRGSAAWARGGRGTSRSTACA*VA
GRPAGRARRS*NRSWDPRSARESCGTRGCSTGTPSGPGASRLPAPSRR*CPPRPDPRRWPSRRGSSCRSAAPCWARSRACGCNRS
AGGSASSGPARSSCPGTWPS*KPPAGGRPAAPCRPR*RRPRRTC*RTGWWRSRRRARSSARRCWPAAPRCAPSGSG*SWPGWG
SPSARAARSRSPHPSR*CAPSGSSRSRAGTAACPRLRCSRAATARSRCTPSSCGRSGSASARSPAGSGPSSRSGSCCW*RSAGCRGA
PRSHTGGRCGGTPRPARASAGRRTSGRSPRGTGPSAASSLPCPSPRPKRSAGSGGSSPPLSS*SPPPRSGGRSRPGSQTLACRPSR*C
ARGES*SPRPPAPPRPAFRPRCPG*CLAKAHAWSCGVSFWAAEAAAMCWESASSRSPRLFLLLGRRPRPRGGRHASSGAEAEATG
SRGSAGGWQSPFRVRGCAPGGAALTDFLRGRPLCSPREQQQAWRLSHRRQHRHLPPPPPPTRTSSRMKA*PPRRPAPPPTPRPQ
TCKRWRNPSRLTWAT*RPRSTRRSWQRAFQPRKRTTKSSQSRKQRTSRTRLGTSMATT*AGQRTCSSSIWPANASSSRTRCSTAPR
CPSAWRSSAAPTSATSSRRACPPSASPTAPVSPTRASTSTRSSRCPRPWPPTTSFSRTKGSPSPAAPTAPAPTPCSTWAPAPAYLISPP

Fig. 24K

WKRFPRSSRVWAATRLGPRTLCKEAERSMSTTAPWWSWKATTRAWRSSSARSS*PTSPTRRSTCPPRS*APSWTRCSSSAPRPSR
RRRCRTPRVRTRASPWSATSSWRAGWERVAPPRAWKSGASS*WPWSW*PWSWSVCAASLPTRRPCARSRRTCTTSSGTGSCAR
PARSPTWS*PTWSPTWASCTRTAWGKTCCTPPCAGRPAATTSATASTCTSATPGRRAWACGSSAWRSRT*KSSASSCRRTSRPCG
PGSTSVPPPRTWPTSSSPSACG*RCATGCPTL*AKACCCKTFALSSSNAPGSCPPPAPRCPRTSCR*PSASAPRRSGATATCCAWPTT
WPTTRT*SRTSAARVCWSATAAATSARRTAPWPATPSC*ARPRSSAPSSCKAPATARARGV*NSPRGCGPRPTCASSCPRTTIPSRS
GSTRTNPSRPRPSCRPASSPRGPSWPNCKPSRNPAKNFC*KRATGSTWTPRPERSSTPASPRMPRGSSKKLKVELPPPEDLEEDWES
SQAEEEEMEDWDSTQAEEDSLQDSLEEEDEVEEAEEEAAAARPSSSAEKASSTDTISAPGRGRGGRAHSRWDETGRFPNPTTQTGK
KERQGYKSWRGHKNAIVSCLQACGGNISFTRRYLLFHRGVNFPRNILHYYRHLHSPYYCFQEEAETQQQQKTSGSSS*KIHSGGRWT
EDRGERAGADPGAEEPDLSHPLCHLPAESGAGAGTESQEPFSALAHPQLSVSQERRPTSAHSRGRRGSLQQVLRAHS*RVARARPH
TEKGGNYVTTCALRPTIMSKEIPTPYMWSYQPQMGLAAGAAQDYSTRMNWLSAGPAMISRVNDIRAHRNQILLEQSAITATPRHH
LNPRNWPAALVYQEIPQPTTVLLPRDAQAEVQLTNSGVQLAGGAALCRHRPAQGIKRLVIRGRGTQLNDEVVSSSLGLRPDGVFQL
AGSGRSSFTPRQAVLTLESSSSQPRSGGIGTLQFVEEFTPSVYFNPFSGSPGHYPDEFIPNFDAISESVDGYD*MSHGGAADLARLRHL
DHCRRFRCFARDLAEFAYFELPEEHPQGPAHGVRIIVEGGLDSHLLRIFSQRPILVEREQGQTLLTLYCICNHPGLHESLCCLLCTEYNKS
*DQRLLRTRLWCSCYQPVPVLHRERDRAPAPV*APQEVPHLAVPGLPDRRCQPLRQRRSPAERPCQPYFFHPQKQAPALPTLPPRD
LSVRLRTLPSHLPPDPEYHSAAPRY*QPNYPPTPPSRPFL*I*YHYRRWLLLLVLPRPVDPRSPTQSPEEVRKCKFQEPWKFLKCYRQK
SDMHPSWIMIIGIVNILACTLISFVIYPCFDFGWNSPEALYLPPEPDTPPQQQPQAHALPPPQPRPQYMPILDYEAEPQRPMLPAISY
FNLTGGDD*PTGQ*QRQRPSPGHGRPRLGAATRPTSHSSAAGESRQGAAGRHSHPPVQERHLLPGETGQDLLRGHPDRPSPLLRA
PAAAPEVHLPGRSQPHRHHPAVGRYQGVHPLLLRLPRLRPHSDQDPLRPPRPPPHELITPLSSEIKIILMMI*IKKIII*FEIKIQSY**FEF
NKNKESLT*NLIPGLCPCFLPTPPHSPLPSSGTAGPGGLQTSSTR*RGCQIPPVPQSSFYLLSDVQKARPGG**LRPRLPLRCRQRTDR
ALHQPPLRLFRWIPREAPGGVVPATG*PRHHQERGNHPQAGRGGGPRLVGKTHLQHGHQGRRPSQYFKQHHFP*NCCPFLQQQ
WNFKPQCLHTISSISHI*HFRHKSWKRSSDFK*VVDCTTNSSSYIQLK*HHSKNRQRAIY*LQWKQRT*G*YKPKKRTSF*R*CYCNIY
WKWLRLWIL***WKNKTRNYQNWSRIKF*C*QSNSCQTRHRFKF*LRWCLDSWKQTG*QANTLDYP*PKP*LSITFRQRCQIYSLS
YKMR*SNTRHCGSGGCYCRISTKSN**HSQKRHSFP*I*FRWCTHVKLINGR*LLEL*GGTDHSKCSLYKCCGIHAKYRCISKNPK*NT
*K*HSQSGIFNWRNYYANDTNHNFQWH**KRHNPS*HLLYDFYMAVDWRL*GQKYYLCYQLILFFLHRPGIIPPSKPTPFPTTFVY
METLKQKNKVQVFY*INSFTGLEQLFFLHPPRTWNTPPSPPAQP*TSECHW*WTCFWSPRSTQFQSEPVSDRSGR*NPPGTPASA
PHSSTAEDCPRWSGSRLSGRSRRAAVGIIVRERDRPVVSHQAPQQSLPPPLRQAAAQGVRVQGLPQHDAHGPQHQSSGAAGAAA
HANLAQVTAVRATQDHQVVQQSIVQHAPAETHRGKDATHVAVVPDPQVNQVALPPEDAAHVHDLLGHVAVHHLPVPHHPLVE
HAAPDDPAEPQGQHRPARHAAKRPRIPAMTMEDPPLVPVDHLGAEQVYVGTAQAYAHASLQHSQLLGGQNHIPGHGELLQDSE
PRRTGQSSHITYIVHGQGIAIRQHRVILHQRSAGLGLLTAW*GGRPIRVMAGRG*SCSRPCHDAVAFGHFRTCCSRTWSGRCTPIA
GGGLGAWNARC*SCKTATLSDRAADLGPQERSHHAL*SHRPPWNGPGPAR*CNFVGFR*RRGREEQEEP*LTFNPNGLGAL
QNEGHGDGTSRPRCVGGK*QPGQR*YGSRDVPRWLPAKPPRAHPETRQ*RKREGSLIPQPSCYTPAPSPDNFHFSSLE*FELVPEV
NPSQP**KARAEHPPPAFLSTPS*FQDILLLVHLQQIDKRNIKISAAIPELLPQQ*L*VLFHIVSEIFSHRTPRNKRRASHITDKPKSPPVSI
AKCKIEISMLARPGDIFQITGQKIG*AIFKKINKRKIFQVHV*GLGNNDGVSARGAFQHG*LADL*KNKK*NIKPC*PGEQVGKSFSPA
PGRPRGLRRDPRKNCRYD*KPSQRDVPGGRRE*FEKKHTPPEHWSP*VKKSGRGSNEALQRSLSSPAKRCHADEAQNFQVRKKCN
YSPPAQAAKLPIPPDTHTKPQRP*LTERQQQRHTTGARVREKTEL*PVRPLSAQYIAPDLH*RKGQSLKIPAK*SHTPSTRPETGDTLR
KIRALPQTAKLPSFPGSHATSSKHDFQIPSTVKNITRPAPNGRRSRSQSPSSLPKFKQLICILTRTKSLRYIIDD

Fig. 25A

AdC6 020-DU422gp160(E1621) Nucleic Acids – SEQ ID NO: 6

```
CATCATCAATAATATACCTCAAACTTTTGGTGCGCGTTAATATGCAAATGAGCTGTTTGAATTTGGGGAGGGAGGAAGGTGAT
TGGCTGCGGGAGCGGCGACCGTTAGGGGCGGGGCGGGTGACGTTTTGATGACGTGGCTATGAGGCGGAGCCGGTTTGCAAG
TTCTCGTGGGAAAAGTGACGTCAAACGAGGTGTGGTTTGAACACGGAAATACTCAATTTTCCCGCGCTCTCTGACAGGAAATG
AGGTGTTTCTGGGCGGATGCAAGTGAAAACGGGCCATTTTCGCGCGAAAACTGAATGAGGAAGTGAAAATCTGAGTAATTTC
GCGTTTATGGCAGGGAGGAGTATTTGCCGAGGGCCGAGTAGACTTTGACCGATTACGTGGGGGTTTCGATTACCGTATTTTTC
ACCTAAATTTCCGCGTACGGTGTCAAAGTCCGGTGTTTTTACGTACGATATCATTTCCCCGAAAGTGCCACCTGACCGTAACTAT
AACGGTCCTAAGGTAGCGAAAGCTCAGATCTCCCGATCCCTATGGTGCACTCTCAGTACAATCTGCTCTGATGCCGCATAGTT
AAGCCAGTATCTGCTCCCTGCTTGTGTGTTGGAGGTCGCTGAGTAGTGCGCGAGCAAAATTTAAGCTACAACAAGGCAAGGCT
TGACCGACAATTGCATGAAGAATCTGCTTAGGGTTAGGCGTTTTGCGCTGCTTCGCGATGTACGGGCCAGATATACGCGTTGA
CATTGATTATTGACTAGTATGCCAAGTACGCCCCCTATTGACGTCAATGACGGTAAATGGCCCGCCTGGCATTATGCCCAGTAC
ATGACCTTATGGGACTTTCCTACTTGGCAGTACATCTACGTATTAGTCATCGCTATTACCATGGTGATGCGGTTTTGGCAGTACA
TCAATGGGCGTGGATAGCGGTTTGACTCACGGGGATTTCCAAGTCTCCACCCCATTGACGTCAATGGGAGTTTGTTTTGGCACC
AAAATCAACGGGACTTTCCAAAATGTCGTAACAACTCCGCCCCATTGACGCAAATGGGCGGTAGGCGTGTACGGTGGGAGGT
CTATATAAGCAGAGCTCGTTTAGTGAACCGTCAGATCACTAGAAGCTTTATTGCGGTAGTTTATCACAGTTAAATTGCTAACGC
AGTCAGTGCTTCTGACACAACAGTCTCGAACTTAAGGCTAGAGTTCGACGCCACCATGCGCGTGCGCGGCATCCCCCGCAACT
GGCCCCAGTGGTGGATCTGGGGCATCCTGGGCTTCTGGATGATCATCATCTGCCGCGTGGTGGGCAACCTGGACCTGTGGGT
GACCGTGTACTACGGCGTGCCCGTGTGGAAGGAGGCCAAGACCACCCTGTTCTGCGCCTCCGACGCCAAGGCCTACGACAAG
GAGGTGCACAACGTGTGGGCCACCCACGCCTGCGTGCCCACCGACCCCAACCCCCAGGAGATCGTGCTGGAGAACGTGACCG
AGAACTTCAACATGTGGAAGAACGACATGGTGGACCAGATGCACGAGGACATCATCTCCCTGTGGGACCAGTCCCTGAAGCC
CTGCGTGAAGCTGACCCCCCTGTGCGTGACCCTGAACTGCAAGAACGTGAACATCTCCGCCAACGCCAACGCCACCGCCACCC
TGAACTCCTCCATGAACGGCGAGATCAAGAACTGCTCCTTCAACACCACCACCGAGCTGCGCGACAAGAAGCAGAAGGTGTAC
GCCCTGTTCTACAAGCCCGACGTGGTGCCCCTGAACGGCGGCGAGCACAACGAGACCGGCGAGTACATCCTGATCAACTGCA
ACTCCTCCACCATCACCCAGGCCTGCCCCAAGGTGTCCTTCGACCCCATCCCCATCCACTACTGCGCCCCCGCCGGCTACGCCAT
CCTGAAGTGCAACAACAAGACCTTCAACGGCACCGGCCCCTGCAACAACGTGTCCACCGTGCAGTGCACCCACGGCATCAAGC
CCGTGGTGTCCACCCAGCTGCTGCTGAACGGCTCCCTGGCCGAGGAGGAGATCATCGTGCGCTCCGAGAACCTGACCAACAAC
ATCAAGACCATCATCGTGCACCTGAACAAGTCCGTGGAGATCAAGTGCACCCGCCCCAACAACAACACCCGCAAGTCCGTGCG
CATCGGCCCCGGCCAGACCTTCTACGCCACCGGCGAGATCATCGGCGACATCCGCGAGGCCCACTGCAACATCTCCCGCGAGA
CCTGGAACTCCACCCTGATCCAGGTGAAGGAGAAGCTGCGCGAGCACTACAACAAGACCATCAAGTTCGAGCCCTCCTCCGGC
GGCGACCTGGAGGTGACCACCCACTCCTTCAACTGCCGCGGCGAGTTCTTCTACTGCGACACCACCAAGCTGTTCAACGAGAC
CAAGCTGTTCAACGAGTCCGAGTACGTGGACAACAAGACCATCATCCTGCCCTGCCGCATCAAGCAGATCATCAACATGTGGC
AGGAGGTGGGCCGCGCCATGTACGCCCCCCCCATCGAGGGCAACATCACCTGCAAGTCCAACATCACCGGCCTGCTGCTGACC
TGGGACGGCGGCGAGAACTCCACCGAGGGCGTGTTCCGCCCCGGCGGCGGCAACATGAAGGACAACTGGCGCTCCGAGCTG
TACAAGTACAAGGTGGTGGAGATCAAGCCCCTGGGCGTGGCCCCCACCAAGAGCAAGCGCAAGGTGGTGGGCCGCGAGAAG
CGCGCCGTGGGCCTGGGCGCCGTGCTGCTGGGCTTCCTGGGCGCCGCCGGCAGCACCATGGGCGCCGCCAGCATCACCCTGA
CCGTGCAGGCCCGCCAGCTGCTGAGCGGCATCGTGCAGCAGCAGAGCAACCTGCTGCGCGCCATCGAGGCCCAGCAGCACCT
GCTGCAGCTGACCGTGTGGGGCATCAAGCAGCTGCAGACCCGCGTGCTGGCCATCGAGCGCTACCTGAAGGACCAGCAGCTG
CTGGGCCTGTGGGGCTGCAGCGGCAAGCTGATCTGCGCCACCGCCGTGCCCTGGAACAGCAGCTGGAGCAACAAGAGCCTG
GGCGACATCTGGGACAACATGACCTGGATGCAGTGGGACCGCGAGATCAGCAACTACACCAACACCATCTTCCGCCTGCTGG
AGGACAGCCAGAACCAGCAGGAGAAGAACGAGAAGGACCTGCTGGCCCTGGACAGCTGGAAGAACCTGTGGAACTGGTTCG
ACATCACCAACTGGCTGTGGTACATCAAGATCTTCATCATGATCGTGGGCGGCCTGATCGGCCTGCGCATCATCTTCGGCGTGC
TGGCCATCGTGAAGCGCGTGCGCCAGGGCTACAGCCCCCTGAGCTTCCAGACCCTGATCCCCAACCCCCGCGGCCCCGACCGC
CTGGGCCGCATCGAGGAGGAGGGCGGCGAGCAGGACAAGGACCGCAGCATCCGCCTGGTGAGCGGCTTCCTGGCCCTGGCC
TGGGACGACCTGCGCAGCCTGTGCCTGTTCAGCTACCACCAGCTGCGCGACTTCATCCTGACCGCCGCCCGCGCCGCCGAGCT
GCTGGGCCGCAGCAGCCTGCGCGGCCTGCAGCGCGGCTGGGAGGTGCTGAAGTACCTGGGCAACCTGGTGCAGTACTGGGG
CCTGGAGCTGAAGCGCAGCGCCATCAACCTGTTCGACACCATCGCCATCGCCGTGGCCGAGGGCACCGACCGCATCATCGAG
GTGATCCAGCGCATCTGCCGCGCCATCCGCTACATCCCCACCCGCATCCGCCAGGGCTTCGAGGCCGCCCTGCTGTAAGGTACC
TCTAGAGTCGACCCGGGCGGCCAAACCGCTGATCAGCCTCGACTGTGCCTTCTAGTTGCCAGCCATCTGTTGTTTGCCCCTCCC
CCGTGCCTTCCTTGACCCTGGAAGGTGCCACTCCCACTGTCCTTTCCTAATAAAATGAGGAAATTGCATCGCATTGTCTGAGTA
GGTGTCATTCTATTCTGGGGGGTGGGGTGGGGCAGGACAGCAAGGGGGAGGATTGGGAAGACAATAGCAGGCATGCTGGG
```

Fig. 25B

```
GATGCGGTGGGCTCTATGGCTTCTGAGGCGGAAAGAACCAGCAGATCTGCAGATCTGAATTCATCTATGTCGGGTGCGGAGA
AAGAGGTAATGAAATGGCATTATGGGTATTATGGGTCTGCATTAATGAATCGGTCAGATATCGACATATGCTGGCCACCGTGC
ATGTGGCCTCGCACCCCGCAAGACATGGCCCGAGTTCGAGCACAACGTCATGACCCGCTGCAATGTGCACCTGGGCTCCCGC
CGAGGCATGTTCATGCCCTACCAGTGCAACATGCAATTTGTGAAGGTGCTGCTGGAGCCCGATGCCATGTCCAGAGTGAGCCT
GACGGGGGTGTTTGACATGAATGTGGAGCTGTGGAAAATTCTGAGATATGATGAATCCAAGACCAGGTGCCGGGCCTGCGAA
TGCGGAGGCAAGCACGCCAGGCTTCAGCCCGTGTGTGGAGGTGACGGAGGACCTGCGACCCGATCATTTGGTGTTGTCCT
GCAACGGGACGGAGTTCGGCTCCAGCGGGGAAGAATCTGACTAGAGTGAGTAGTGTTTGGGGCTGGGTGTGAGCCTGCATG
AGGGGCAGAATGACTAAAATCTGTGGTTTTCTGTGTGTTGCAGCAGCATGAGCGGAAGCGCCTCCTTTGAGGGAGGGGTATT
CAGCCCTTATCTGACGGGGCGTCTCCCCTCCTGGGCGGGAGTGCGTCAGAATGTGATGGGATCCACGGTGGACGGCCGGCCC
GTGCAGCCCGCGAACTCTTCAACCCTGACCTACGCGACCCTGAGCTCCTCGTCCGTGGACGCAGCTGCCGCCGCAGCTGCTGCT
TCCGCCGCCAGCGCCGTGCGCGGAATGGCCCTGGGCGCCGGCTACTACAGCTCTCTGGTGGCCAACTCGAGTTCCACCAATAA
TCCCGCCAGCCTGAACGAGGAGAAGCTGCTGCTGCTGATGGCCCAGCTCGAGGCCCTGACCCAGCGCCTGGGCGAGCTGACC
CAGCAGGTGGCTCAGCTGCAGGCGGAGACGCGGGCCGCGGTTGCCACGGTGAAAACCAAATAAAAAATGAATCAATAAATA
AACGGAGACGGTTGTTGATTTTAACACAGAGTCTTGAATCTTTATTTGATTTTTCGCGCGCGGTAGGCCCTGGACCACCGGTCT
CGATCATTGAGCACCCGGTGGATCTTTTCCAGGACCCGGTAGAGGTGGGCTTGGATGTTGAGGTACATGGGCATGAGCCCGT
CCCGGGGGTGGAGGTAGCTCCATTGCAGGGCCTCGTGCTCGGGGATGGTGTTGTAAATCACCCAGTCATAGCAGGGGCGCAG
GGCGTGGTGCTGCACGATGTCCTTGAGGAGGAGACTGATGGCCACGGGCAGCCCCTTGGTGTAGGTGTTGACGAACCTGTTG
AGCTGGGAGGGATGCATGCGGGGGGAGATGAGATGCATCTTGGCCTGGATCTTGAGATTGGCGATGTTCCCGCCCAGATCCC
GCCGGGGGTTCATGTTGTGCAGGACCACCAGCACGGTGTATCCGGTGCACTTGGGGAATTTGTCATGCAACTTGGAAGGGAA
GGCGTGAAAGAATTTGGAGACGCCCTTGTGACCGCCCAGGTTTTCCATGCACTCATCCATGATGATGGCGATGGGCCCGTGGG
CGGCGGCCTGGGCAAAGACGTTTCGGGGGTCGGACACATCGTAGTTGTGGTCCTGGGTGAGCTCGTCATAGGCCATTTTAAT
GAATTTGGGGCGGAGGGTGCCCGACTGGGGACGAAGGTGCCCTCGATCCCGGGGGCGTAGTTGCCCTCGCAGATCTGCAT
CTCCCAGGCCTTGAGCTCGGAGGGGGGGATCATGTCCACCTGCGGGGCGATGAAAAAAACGGTTTCCGGGGCGGGGGAGAT
GAGCTGGGCCGAAAGCAGGTTCCGGAGCAGCTGGGACTTGCCGCAACCGGTGGGGCCGTAGATGACCCCGATGACCGGCTG
CAGGTGGTAGTTGAGGGAGAGACAGCTGCCGTCCTCGCGGAGGAGGGGGGCCACCTCGTTCATCATCTCGCGCACATGCATG
TTCTCGCGCACGAGTTCCGCCAGGAGGCGCTCGCCCCCAGCGAGAGGAGCTCTTGCAGCGAGGCGAAGTTTTTCAGCGGCTT
GAGTCCGTCGGCCATGGGCATTTTGGAGAGGGTCTGTTGCAAGAGTTCCAGACGGTCCCAGAGCTCGGTGATGTGCTCTAGG
GCATCTCGATCCAGCAGACCTCCTCGTTTCGCGGGTTGGGGCGACTGCGGGAGTAGGGCACCAGGCGATGGGCGTCCAGCGA
GGCCAGGGTCCGGTCCTTCCAGGGCCGCAGGGTCCGCGTCAGCGTGGTCTCCGTCACGGTGAAGGGGTGCGCGCCGGGCTG
GGCGCTTGCGAGGGTGCGCTTCAGGCTCATCCGGCTGGTCGAGAACCGCTCCCGGTCGGCGCCCTGCGCGTCGGCCAGGTAG
CAATTGAGCATGAGTTCGTAGTTGAGCGCCTCGGCCGCGTGGCCCTTGGCGCGGAGCTTACCTTTGGAAGTGTGTCCGCAGAC
GGGACAGAGGAGGGACTTGAGGGCGTAGAGCTTGGGGGCGAGGAAGACGGACTCGGGGGCGTAGGCGTCCGCGCCGCAG
CTGGCGCAGACGGTCTCGCACTCCACGAGCCAGGTGAGGTCGGGGCGGTTGGGGTCAAAAACGAGGTTTCCTCCGTGCTTTT
TGATGCGTTTCTTACCTCTGGTCTCCATGAGCTCGTGTCCCCGCTGGGTGACAAAGAGGCTGTCCGTGTCCCCGTAGACCGACT
TTATGGGCCGGTCCTCGAGCGGGGTGCCGCGGTCCTCGTCGTAGAGGAACCCCGCCCACTCCGAGACGAAGGCCCGGGTCCA
GGCCAGCACGAAGGAGGCCACGTGGGAGGGGTAGCGGTCGTTGTCCACCAGCGGGTCCACCTTCTCCAGGGTATGCAAGCA
CATGTCCCCCTCGTCCACATCCAGGAAGGTGATTGGCTTGTAAGTGTAGGCCACGTGACCGGGGGTCCCGGCCGGGGGGTA
TAAAAGGGGGCGGGCCCCTGCTCGTCCTCACTGTCTTCCGGATCGCTGTCCAGGAGCGCCAGCTGTTGGGGTAGGTATTCCCT
CTCGAAGGCGGGCATGACCTCGGCACTCAGGTTGTCAGTTCTAGAAACGAGGAGGATTTGATATTGACGGTGCCGTTGGAG
ACGCCTTTCATGAGCCCCTCGTCCATTTGGTCAGAAAAGACGATCTTTTTGTTGTCGAGCTTGGTGGCGAAGGAGCCGTAGAG
GGCGTTGGAGAGCAGCTTGGCGATGGAGCGCATGGTCTGGTTCTTTTCCTTGTCGGCGCGCTCCTTGGCGGCGATGTTGAGCT
GCACGTACTCGCGCGCCACGCACTTCCATTCGGGGAAGACGGTGGTGAGCTCGTCGGGCACGATTCTGACCCGCCAGCCGCG
GTTGTGCAGGGTGATGAGGTCCACGCTGGTGGCCACCTCGCCGCGCAGGGCTCGTTGGTCCAGCAGAGGCGCCCGCCCTTG
CGCGAGCAGAAGGGGGGCAGCGGGTCCAGCATGAGCTCGTCGGGGGGTCGGCGTCCACGGTGAAGATGCCGGGCAGGAG
CTCGGGGTCGAAGTAGCTGATGCAGGTGCCCAGATTGTCCAGCGCCGCTTGCCAGTCGCGCACGGCCAGCGCGCGCTCGTAG
GGGCTGAGGGCGTGCCCCAGGGCATGGGTGCGTGAGCGCGGAGGCGTACATGCCGCAGATGTCGTAGACGTAGAGGGG
CTCCTCGAGGACGCCGATGTAGGTGGGGTAGCAGCGCCCCCGCGGATGCTGGCGCGCACGTAGTCGTACAGCTCGTGCGAG
GGCGCGAGGAGCCCCGTGCCGAGGTTGGAGCGTTGCGGCTTTTCGGCGCGGTAGACGATCTGGCGGAAGATGGCGTGGGAG
TTGGAGGAGATGGTGGGCCTTTGGAAGATGTTGAAGTGGGCGTGGGCAGGCCGACCGAGTCCCTGATGAAGTGGGCGTAG
GAGTCCTGCAGCTTGGCGACGAGCTCGGCGGTGACGAGGACGTCCAGGGCGCAGTAGTCGAGGGTCTCTTGGATGATGTCAT
ACTTGAGCTGGCCCTTCTGCTTCCACAGCTCGCGGTTGAGAAGGAACTCTTCGCGGTCCTTCCAGTACTCTTCGAGGGGGAACC
```

Fig. 25C

```
CGTCCTGATCGGCACGGTAAGAGCCCACCATGTAGAACTGGTTGACGGCCTTGTAGGCGCAGCAGCCCTTCTCCACGGGGAG
GGCGTAAGCTTGCGCGGCCTTGCGCAGGGAGGTGTGGGTGAGGGCGAAGGTGTCGCGCACCATGACCTTGAGGAACTGGTG
CTTGAAGTCGAGGTCGTCGCAGCCGCCCTGCTCCCAGAGTTGGAAGTCCGTGCGCTTCTTGTAGGCGGGGTTAGGCAAAGCG
AAAGTAACATCGTTGAAGAGGATCTTGCCCGCGCGGGGCATGAAGTTGCGAGTGATGCGGAAAGGCTGGGGCACCTCGGCC
CGGTTGTTGATGACCTGGGCGGCGAGGACGATCTCGTCGAAGCCGTTGATGTTGTGCCCGACGATGTAGAGTTCCACGAATC
GCGGGCGGCCCTTGACGTGGGGCAGCTTCTTGAGCTCGTCGTAGGTGAGCTCGGCGGGGTCGCTGAGCCCGTGCTGCTCGAG
GGCCCAGTCGGCGACGTGGGGGTTGGCGCTGAGGAAGGAAGTCCAGAGATCCACGGCCAGGGCGGTCTGCAAGCGGTCCCG
GTACTGACGGAACTGTTGGCCCACGGCCATTTTTTCGGGGGTGACGCAGTAGAAGGTGCGGGGGTCGCCGTGCCAGCGGTCC
CACTTGAGCTGGAGGGCGAGGTCGTGGGCGAGCTCGACGAGCGGCGGGTCCCCGGAGAGTTTCATGACCAGCATGAAGGGG
ACGAGCTGCTTGCCGAAGGACCCCATCCAGGTGTAGGTTTCCACATCGTAGGTGAGGAAGAGCCTTTCGGTGCGAGGATGCG
AGCCGATGGGGAAGAACTGGATCTCCTGCCACCAGTTGGAGGAATGGCTGTTGATGTGATGGAAGTAGAAATGCCGACGGC
GCGCCGAGCACTCGTGCTTGTGTTTATACAAGCGTCCGCAGTGCTCGCAACGCTGCACGGGATGCACGTGCTGCACGAGCTGT
ACCTGGGTTCCTTTGGCGAGGAATTTCAGTGGGCAGTGGAGCGCTGGCGGCTGCATCTCGTGCTGTACTACGTCTTGGCCATC
GGCGTGGCCATCGTCTGCCTCGATGGTGGTCATGCTGACGAGCCCGCGCGGGAGGCAGGTCCAGACCTCGGCTCGGACGGGT
CGGAGAGCGAGGACGAGGGCGCGCAGGCCGGAGCTGTCCAGGGTCCTGAGACGCTGCGGAGTCAGGTCAGTGGGCAGCGG
CGGCGCGCGGTTGACTTGCAGGAGCTTTTCCAGGGCGCGCGGGAGGTCCAGATGGTACTTGATCTCCACGGCGCCGTTGGTG
GCTACGTCCACGGCTTGCAGGGTGCCGTGCCCCTGGGGCGCCACCACCGTGCCCCGTTTCTTCTTGGGCGCTGCTTCCATGTCG
GTCAGAAGCGGCGGCGAGGACGCGCGCCGGGCGGCAGGGGCGGCTCGGGCCCGGAGGCAGGGCGGCAGGGGCACGTC
GGCGCCGCGCGCGGGCAGGTTCTGGTACTGCGCCCGGAGAAGACTGGCGTGAGCGACGACGCGACGGTTGACGTCCTGGAT
CTGACGCCTCTGGGTGAAGGCCACGGGACCCGTGAGTTTGAACCTGAAAGAGAGTTCGACAGAATCAATCTCGGTATCGTTG
ACGGCGGCCTGCCGCAGGATCTCTTGCACGTCGCCCGAGTTGTCCTGGTAGGCGATCTCGGTCATGAACTGCTCGATCTCCTCC
TCCTGAAGGTCTCCGCGGCCGGCGCGCTCGACGGTGGCCGCGAGGTCGTTGGAGATGCGGCCCATGAGCTGCGAGAAGGCG
TTCATGCCGGCCTCGTTCCAGACGCGGCTGTAGACCACGGCTCCGTCGGGGTCGCGCGCGCGCATGACCACCTGGGCGAGGT
TGAGCTCGACGTGGCGCGTGAAGACCGCGTAGTTGCAGAGGCGCTGGTAGAGGTAGTTGAGCGTGGTGGCGATGTGCTCGG
TGACGAAGAAGTACATGATCCAGCGGCGGAGCGGCATCTCGCTGACGTCGCCCAGGGCTTCCAAGCGTTCCATGGCCTCGTA
GAAGTCCACGGCGAAGTTGAAAAACTGGGAGTTGCGCGCCGAGACGGTCAACTCCTCCTCCAGAAGACGGATGAGCTCGGCG
ATGGTGGCGCGCACCTCGCGCTCGAAGGCCCCGGGGGGCTCCTCTTCCATCTCCTCCTCTTCCTCCTCCACTAACATCTCTTCTA
CTTCCTCCTCAGGAGGCGGTGGCGGGGAGGGGCCCTGCGTCGCCGGCGGCGCACGGGCAGACGGTCGATGAAGCGCTCGA
TGGTCTCCCCGCGCCGGCGACGCATGGTCTCGGTGACGGCGCGCCCGTCCTCGCGGGCCGCAGCATGAAGACGCCGCCGCG
CATCTCCAGGTGGCCGCCGGGGGGGTCTCCGTTGGGCAGGGAGAGGGCGCTGACGATGCATCTTATCAATTGACCCGTAGGG
ACTCCGCGCAAGGACCTGAGCGTCTCGAGATCCACGGGATCCGAAAACCGCTGAACGAAGGCTTCGAGCCAGTCGCAGTCGC
AAGGTAGGCTGAGCCCGGTTTCTTGTTCTTCGGGTATTTGGTCGGGAGGCGGGCGGGCGATGCTGCTGGTGATGAAGTTGAA
GTAGGCGGTCCTGAGACGGCGGATGGTGGCGAGGAGCACCAGGTCCTTGGGCCCGGCTTGCTGGATGCGCAGACGGTCGGC
CATGCCCCAGGCGTGGTCCTGACACCTGGCGAGGTCCTTGTAGTAGTCCTGCATGAGCCGCTCCACGGGCACCTCCTCCTCGCC
CGCGCGGCCGTGCATGCGCGTGAGCCCGAACCCGCGCTGCGGCTGGACGAGCGCCAGGTCGGCGACGACGCGCTCGGTGAG
GATGGCCTGCTGGATCTGGGTGAGGGTGGTCTGGAAGTCGTCGAAGTCGACGAAGCGGTGGTAGGCTCCGGTGTTGATGGT
GTAGGAGCAGTTGGCCATGACGGACCAGTTGACGGTCTGGTGGCCGGGTCGCACGAGCTCGTGGTACTTGAGGCGCGAGTA
GGCGCGCGTGTCGAAGATGTAGTCGTTGCAGGCGCGCACGAGGTACTGGTATCCGACGAGGAAGTGCGGCGGCGGCTGGCG
GTAGAGCGGCCATCGCTCGGTGGCGGGGCGCCGGGCGCGAGGTCCTCGAGCATGAGGCGGTGGTAGCCGTAGATGTACCT
GGACATCCAGGTGATGCCGGCGGCGGTGGTGGAGGCGCGCGGGAACTCGCGGACGCGGTTCCAGATGTTGCGCAGCGGCA
GGAAGTAGTTCATGGTGGCCGCGGTCTGGCCCGTGAGGCGCGCGCAGTCGTGGATGCTCTAGACATACGGGCAAAAACGAA
AGCGGTCAGCGGCTCGACTCCGTGGCCTGGAGGCTAAGCGAACGGGTTGGGCTGCGCGTGTACCCCGGTTCGAATCTCGAAT
CAGGCTGGAGCCGCAGCTAACGTGGTACTGGCACTCCCGTCTCGACCCAAGCCTGCTAACGAAACCTCCAGGATACGGAGGC
GGGTCGTTTTTTGGCCTTGGTCGCTGGTCATGAAAAACTAGTAAGCGCGGAAAGCGGCCGCCCGCGATGGCTCGCTGCCGTA
GTCTGGAGAAAGAATCGCCAGGGTTGCGTTGCGGTGTGCCCCGGTTCGAGCCTCAGCGCTCGGCGCCGGCCGGATTCCGCGG
CTAACGTGGGCGTGGCTGCCCCGTCGTTTCCAAGACCCCTTAGCCAGCCGACTTCTCCAGTTACGGAGCGAGCCCCTCTTTTTTT
TTCTTGTGTTTTTGCCAGATGCATCCCGTACTGCGGCAGATGCGCCCCACCCTCCACCACAACCGCCCCTACCGCAGCAGCAG
CAACAGCCGGCGCTTCTGCCCCCGCCCCAGCAGCAGCCAGCCACTACCGCGGCGGCCGCCGTGAGCGGAGCCGGCGTTCAGT
ATGACCTGGCCTTGGAAGAGGGCGAGGGGCTGGCGCGGCTGGGGCGTCGTCGCCGGAGCGGCACCCGCGCGTGCAGATG
AAAAGGGACGCTCGCGAGGCCTACGTGCCCAAGCAGAACCTGTTCAGAGACAGGAGCGGCGAGGAGCCCGAGGAGATGCGC
GCCTCCCGCTTCCACGCGGGGCGGGAGCTGCGGCGCGGCCTGGACCGAAAGCGGGTGCTGAGGGACGAGGATTTCGAGGCG
```

Fig. 25D

```
GACGAGCTGACGGGGATCAGCCCCGCGCGCGCGCACGTGGCCGCGGCCAACCTGGTCACGGCGTACGAGCAGACCGTGAAG
GAGGAGAGCAACTTCCAAAAATCCTTCAACAACCACGTGCGCACGCTGATCGCGCGCGAGGAGGTGACCCTGGGCCTGATGC
ACCTGTGGGACCTGCTGGAGGCCATCGTGCAGAACCCCACGAGCAAGCCGCTGACGGCGCAGCTGTTTCTGGTGGTGCAGCA
CAGTCGGGACAACGAGACGTTCAGGGAGGCGCTGCTGAATATCACCGAGCCCGAGGGCCGCTGGCTCCTGGACCTGGTGAAC
ATTTTGCAGAGCATCGTGGTGCAGGAGCGCGGGCTGCCGCTGTCCGAGAAGCTGGCGGCCATCAACTTCTCGGTGCTGAGTC
TGGGCAAGTACTACGCTAGGAAGATCTACAAGACCCGTACGTGCCCATAGACAAGGAGGTGAAGATCGACGGGTTTTACAT
GCGCATGACCCTGAAAGTGCTGACCCTGAGCGACGATCTGGGGGTGTACCGCAACGACAGGATGCACCGCGCGGTGAGCGC
CAGCCGCCGGCGCGAGCTGAGCGACCAGGAGCTGATGCACAGCCTGCAGCGGGCCCTGACCGGGGCCGGGACCGAGGGGGG
AGAGCTACTTTGACATGGGCGCGGACCTGCGCTGGCAGCCCAGCCGCCGGGCCTTGGAAGCTGCCGGCGGTTCCCCCTACGT
GGAGGAGGTGGACGATGAGGAGGAGGAGGGCGAGTACCTGGAAGACTGATGGCGCGACCGTATTTTTGCTAGATGCAGCA
ACAGCCACCGCCGCCGCCTCCTGATCCCGCGATGCGGGCGGCGCTGCAGAGCCAGCCGTCCGGCATTAACTCCTCGGACGATT
GGACCCAGGCCATGCAACGCATCATGGCGCTGACGACCCGCAATCCCGAAGCCTTTAGACAGCAGCCTCAGGCCAACCGGCTC
TCGGCCATCCTGGAGGCCGTGGTGCCCTCGCGCTCGAACCCCACGCACGAGAAGGTGCTGGCCATCGTGAACGCGCTGGTGG
AGAACAAGGCCATCCGCGGTGACGAGGCCGGGCTGGTGTACAACGCGCTGCTGGAGCGCGTGGCCCGCTACAACAGCACCA
ACGTGCAGACGAACCTGGACCGCATGGTGACCGACGTGCGCGAGGCGGTGTCGCAGCGCGAGCGGTTCCACCGCGAGTCGA
ACCTGGGCTCCATGGTGGCGCTGAACGCCTTCCTGAGCACGCAGCCCGCCAACGTGCCCCGGGGCCAGGAGGACTACACCAA
CTTCATCAGCGCGCTGCGGCTGATGGTGGCCGAGGTGCCCCAGAGCGAGGTGTACCAGTCGGGGCCGGACTACTTCTTCCAG
ACCAGTCGCCAGGGCTTGCAGACCGTGAACCTGAGCCAGGCTTTCAAGAACTTGCAGGGACTGTGGGGCGTGCAGGCCCCGG
TCGGGGACCGCGCGACGGTGTCGAGCCTGCTGACGCCGAACTCGCGCCTGCTGCTGCTGCTGGTGGCGCCCTTCACGGACAG
CGGCAGCGTGAGCCGCGACTCGTACCTGGGCTACCTGCTTAACCTGTACCGCGAGGCCATCGGACAGGCGCACGTGGACGAG
CAGACCTACCAGGAGATCACCCACGTGAGCCGCGCGCTGGGCCAGGAGGACCCGGGCAACCTGGAGGCCACCCTGAACTTCC
TGCTGACCAACCGGTCGCAGAAGATCCCGCCCCAGTACGCGCTGAGCACCGAGGAGGAGCGCATCCTGCGCTACGTGCAGCA
GAGCGTGGGGCTGTTCCTGATGCAGGAGGGGGCCACGCCCAGCGCGGCGCTCGACATGACCGCGCGCAACATGGAGCCCAG
CATGTACGCCCGCAACCGCCCGTTCATCAATAAGCTGATGGACTACTTGCATCGGGCGGCCGCCATGAACTCGGACTACTTTAC
CAACGCCATCTTGAACCCGCACTGGCTCCCGCCGCCCGGGTTCTACACGGGCGAGTACGACATGCCCGACCCCAACGACGGGT
TCCTGTGGGACGACGTGGACAGCAGCGTGTTCTCGCCGCGTCCAGGAACCAATGCCGTGTGGAAGAAAGAGGGCGGGGACC
GGCGGCCGTCCTCGGCGCTGTCCGGTCGCGCGGGTGCTGCCGCGGCGGTGCCCGAGGCCGCCAGCCCCTTCCCGAGCCTGCC
CTTTTCGCTGAACAGCGTGCGCAGCAGCGAGCTGGGTCGGCTGACGCGACCGCGCCTGCTGGGCGAGGAGGAGTACCTGAAC
GACTCCTTGTTGAGGCCCGAGCGCGAGAAGAACTTCCCCAATAACGGGATAGAGAGCCTGGTGGACAAGATGAGCCGCTGGA
AGACGTACGCGCACGAGCACAGGGACGAGCCCCGAGCTAGCAGCGCAGGCACCCGTAGACGCCAGCGGCACGACAGGCAGC
GGGGACTGGTGTGGGACGATGAGGATTCCGCCGACGACAGCAGCGTGTTGGACTTGGGTGGGAGTGGTGGTAACCCGTTCG
CTCACCTGCGCCCCCGTATCGGGCGCCTGATGTAAGAATCTGAAAAAATAAAAGACGGTACTCACCAAGGCCATGGCGACCAG
CGTGCGTTCTTCTCTGTTGTTTGTAGTAGTATGATGAGGCGCGTGTACCCGGAGGGTCCTCCTCCCTCGTACGAGAGCGTGATG
CAGCAGGCGGTGGCGGCGGCGATGCAGCCCCCGCTGGAGGCGCCTTACGTGCCCCGCGGTACCTGGCGCCTACGGAGGGG
CGGAACAGCATTCGTTACTCGGAGCTGGCACCCTTGTACGATACCACCCGGTTGTACCTGGTGGACAACAAGTCGGCAGACAT
CGCCTCGCTGAACTACCAGAACGACCACAGCAACTTCCTGACCACCGTGGTGCAGAACAACGATTTCACCCCCACGGAGGCCA
GCACCCAGACCATCAACTTTGACGAGCGCTCGCGGTGGGGCGGCCAGCTGAAAACCATCATGCACACCAACATGCCCAACGT
GAACGAGTTCATGTACAGCAACAAGTTCAAGGCGCGGGTGATGGTCTCGCGCAAGACCCCAACGGGGTGGATGATGATTAT
GATGGTAGTCAGGACGAGCTGACCTACGAGTGGGTGGAGTTTGAGCTGCCCGAGGGCAACTTCTCGGTGACCATGACCATCG
ATCTGATGAACAACGCCATCATCGACAACTACTTGGCGGTGGGGCGGCAGAACGGGGTGCTGGAGAGCGACATCGGCGTGA
AGTTCGACACGCGCAACTTCCGGCTGGGCTGGGACCCCGTGACCGAGCTGGTGATGCCGGGCGTGTACACCAACGAGGCCTT
CCACCCCGACATCGTCCTGCTGCCCGGCTGCGGCGTGGACTTCACCGAGAGCCGCCTCAGCAACCTGCTGGGCATCCGCAAGC
GGCAGCCCTTCCAGGAGGGCTTCCAGATCCTGTACGAGGACCTGGAGGGGGGCAACATCCCCGCGCTCTTGGATGTCGAAGC
CTACGAGAAAAGCAAGGAGGATAGCACCGCCGCGGCGACCGCAGCCGTGGCCACCGCCTCTACCGAGGTGCGGGGCGATAA
TTTTGCTAGCGCTGCGGCAGCGGCCGAGGCGGCTGAAACCGAAAGTAAGATAGTCATCCAGCCGGTGGAGAAGGACAGCAA
GGACAGGAGCTACAACGTGCTCGCGGACAAGAAAAACACCGCCTACCGCAGCTGGTACCTGGCCTACAACTACGGCGACCCC
GAGAAGGGCGTGCGCTCCTGGACGCTGCTCACCACCTCGGACGTCACCTGCGGCGTGGAGCAAGTCTACTGGTCGCTGCCCG
ACATGATGCAAGACCCGGTCACCTTCCGCTCCACGCGTCAAGTTAGCAACTACCCGGTGGTGGGCGCCGAGCTCCTGCCCGTC
TACTCCAAGAGCTTCTTCAACGAGCAGGCCGTCTACTCGCAGCAGCTGCGCGCCTTCACCTCGCTCACGCACGTCTTCAACCGC
TTCCCCGAGAACCAGATCCTCGTCCGCCCGCCCGCGCCCACCATTACCACCGTCAGTGAAAACGTTCCTGCTCTCACAGATCAC
GGGACCCTGCCGCTGCGCAGCAGTATCCGGGGAGTCCAGCGCGTGACCGTCACTGACGCCAGACGCCGCACCTGCCCCTACG
```

Fig. 25E

```
TCTACAAGGCCCTGGGCGTAGTCGCGCCGCGCGTCCTCTCGAGCCGCACCTTCTAAAAAATGTCCATTCTCATCTCGCCCAGTA
ATAACACCGGTTGGGGCCTGCGCGCGCCCAGCAAGATGTACGGAGGCGCTCGCCAACGCTCCACGCAACACCCCGTGCGCGT
GCGCGGGCACTTCCGCGCTCCCTGGGGCGCCCTCAAGGGCCGCGTGCGCTCGCGCACCACCGTCGACGACGTGATCGACCAG
GTGGTGGCCGACGCGCGCAACTACACGCCCGCCGCCGCGCCCGTCTCCACCGTGGACGCCGTCATCGACAGCGTGGTGGCCG
ACGCGCGCCGGTACGCCCGCACCAAGAGCCGGCGGCGGCGCATCGCCCGGCGGCACCGGAGCACCCCCGCCATGCGCGCGG
CGCGAGCCTTGCTGCGCAGGGCCAGGCGCACGGGACGCAGGGCCATGCTCAGGGCGGCCAGACGCGCGGCCTCCGGCAGCA
GCAGCGCCGGCAGGACCCGCAGACGCGCGGCCACGGCGGCGGCGGCGGCCATCGCCAGCATGTCCCGCCCGCGGCGCGGCA
ACGTGTACTGGGTGCGCGACGCCGCCACCGGTGTGCGCGTGCCCGTGCGCACCCGCCCCCCTCGCACTTGAAGATGCTGACTT
CGCGATGTTGATGTGTCCCAGCGGCGAGGAGGATGTCCAAGCGCAAATACAAGGAAGAGATGCTCCAGGTCATCGCGCCTGA
GATCTACGGCCCCGCGGCGGCGGTGAAGGAGGAAAGAAAGCCCCGCAAACTGAAGCGGGTCAAAAAGGACAAAAAGGAGG
AGGAAGATGACGGACTGGTGGAGTTTGTGCGCGAGTTCGCCCCCGGCGGCGCGTGCAGTGGCGCGGGCGGAAAGTGAAAC
CGGTGCTGCGGCCCGGCACCACGGTGGTCTTCACGCCCGGCGAGCGTTCCGGCTCCGCCTCCAAGCGCTCCTACGACGAGGT
GTACGGGGACGAGGACATCCTCGAGCAGGCGGTCGAGCGTCTGGGCGAGTTTGCGTACGGCAAGCGCAGCCGCCCCGCGCC
CTTGAAAGAGGAGGCGGTGTCCATCCCGCTGGACCACGGCAACCCCACGCCGAGCCTGAAGCCGGTGACCCTGCAGCAGGTG
CTACCGAGCGCGGCGCCGCGCCGGGGCTTCAAGCGCGAGGGCGGCGAGGATCTGTACCCGACCATGCAGCTGATGGTGCCC
AAGCGCCAGAAGCTGGAGGACGTGCTGGAGCACATGAAGGTGGACCCCGAGGTGCAGCCCGAGGTCAAGGTGCGGCCCATC
AAGCAGGTGGCCCCGGGCCTGGGCGTGCAGACCGTGGACATCAAGATCCCCACGGAGCCCATGGAAACGCAGACCGAGCCC
GTGAAGCCCAGCACCAGCACCATGGAGGTGCAGACGGATCCCTGGATGCCAGCACCAGCTTCCACCAGCACTCGCCGAAGAC
GCAAGTACGGCGCGGCCAGCCTGCTGATGCCCAACTACGCGCTGCATCCTTCCATCATCCCCACGCCGGGCTACCGCGGCACG
CGCTTCTACCGCGGCTACACCAGCAGCCGCCGCCGCAAGACCACCACCCGCCGCCGTCGTCGCAGCCGCCGCAGCAGCACCGC
GACTTCCGCCTTGGTGCGGAGAGTGTATCGCAGCGGGCGCGAGCCTCTGACCCTGCCGCGCGCGCGCTACCACCCGAGCATC
GCCATTTAACTACCGCCTCCTACTTGCAGATATGGCCCTCACATGCCGCCTCCGCGTCCCCATTACGGGCTACCGAGGAAGAAA
GCCGCGCCGTAGAAGGCTGACGGGGAACGGGCTGCGTCGCCATCACCACCGGCGGCGGCGCGCCATCAGCAAGCGGTTGGG
GGGAGGCTTCCTGCCCGCGCTGATCCCCATCATCGCCGCGGCGATCGGGGCGATCCCCGGCATAGCTTCCGTGGCGGTGCAG
GCCTCTCAGCGCCACTGAGACACAAAAAAGCATGGATTTGTAATAAAAAAAAAAATGGACTGACGCTCCTGGTCCTGTGATGT
GTGTTTTTAGATGGAAGACATCAATTTTTCGTCCCTGGCACCGCGACACGGCACGCGGCCGTTTATGGGCACCTGGAGCGACA
TCGGCAACAGCCAACTGAACGGGGGCGCCTTCAATTGGAGCAGTCTCTGGAGCGGGCTTAAGAATTTCGGGTCCACGCTCAA
AACCTATGGCAACAAGGCGTGGAACAGCAGCACAGGGCAGGCGCTGAGGGAAAAGCTGAAAGAACAGAACTTCCAGCAGAA
GGTGGTTGATGGCCTGGCCTCAGGCATCAACGGGGTGGTTGACCTGGCCAACCAGGCCGTGCAGAAACAGATCAACAGCCGC
CTGGACGCGGTCCCGCCCGCGGGGTCCGTGGAGATGCCCCAGGTGGAGGAGGAGCTGCCTCCCCTGGACAAGCGCGGCGAC
AAGCGACCGCGTCCCGACGCGGAGGAGACGCTGCTGACGCACACGGACGAGCCGCCCCCGTACGAGGAGGCGGTGAAACTG
GGCCTGCCCACCACGCGGCCCGTGGCGCCTCTGGCCACCGGAGTGCTGAAACCCAGCAGCAGCCAGCCCGCGACCCTGGACT
TGCCTCCGCCTCGCCCCTCCACAGTGGCTAAGCCCCTGCCGCCGGTGGCCGTCGCGTCGCGCGCCCCCGAGGCCGCCCCCAG
GCGAACTGGCAGAGCACTCTGAACAGCATCGTGGGTCTGGGAGTGCAGAGTGTGAAGCGCCGCCGCTGCTATTAAAAGACAC
TGTAGCGCTTAACTTGCTTGTCTGTGTGTATATGTATGTCCGCCGACCAGAAGGAGGAGTGTGAAGAGGCGCGTCGCCGAGTT
GCAAGATGGCCACCCCATCGATGCTGCCCCAGTGGGCGTACATGCACATCGCCGGACAGGACGCTTCGGAGTACCTGAGTCC
GGGTCTGGTGCAGTTCGCCCGCGCCACAGACACCTACTTCAGTCTGGGGAACAAGTTTAGGAACCCCACGGTGGCGCCCACGC
ACGATGTGACCACCGACCGCAGCCAGCGGCTGACGCTGCGCTTCGTGCCCGTGGACCGCGAGGACAACACCTACTCGTACAA
AGTGCGCTACACGCTGGCCGTGGGCGACAACCGCGTGCTGGACATGGCCAGCACCTACTTTGACATCCGCGGCGTGCTGGAC
CGGGGCCCTAGCTTCAAACCCTACTCTGGCACCGCCTACAACAGCCTAGCTCCCAAGGGAGCTCCCAATTCCAGCCAGTGGGA
GCAAGCAAAAACAGGCAATGGGGGAACTATGGAAACACACACATATGGTGTGGCCCCAATGGGCGGAGAGAATATTACAAA
AGATGGTCTTCAAATTGGAACTGACGTTACAGCGAATCAGAATAAACCAATTTATGCCGACAAAACATTTCAACCAGAACCGC
AAGTAGGAGAAGAAAATTGGCAAGAAACTGAAAACTTTTATGGCGGTAGAGCTCTTAAAAAAGACACAAACATGAAACCTTG
CTATGGCTCCTATGCTAGACCCACCAATGAAAAGGAGGTCAAGCTAAACTTAAAGTTGGAGATGATGGAGTTCCAACCAAAG
AATTCGACATAGACCTGGCTTTCTTTGATACTCCCGGTGGCACCGTGAACGGTCAAGACGAGTATAAAGCAGACATTGTCATGT
ATACCGAAAACACGTATTTGGAAACTCCAGACACGCATGTGGTATACAAACCAGGCAAGGATGATGCAAGTTCTGAAATTAAC
CTGGTTCAGCAGTCTATGCCCAACAGACCCAACTACATTGGGTTCAGGGACAACTTTATCGGTCTTATGTACTACAACAGCACT
GGCAATATGGGTGTGCTTGCTGGTCAGGCCTCCCAGCTGAATGCTGTGGTTGATTTGCAAGACAGAAACACCGAGCTGTCCTA
CCAGCTCTTGCTTGACTCTTTGGGTGACAGAACCCGGTATTTCAGTATGTGGAACCAGGCGGTGGACAGTTATGACCCCGATG
TGCGCATCATCGAAAACCATGGTGTGGAGGATGAATTGCCAAACTATTGCTTCCCCTTGGACGGCTCTGGCACTAACGCCGCA
TACCAAGGTGTGAAAGTAAAAGATGGTCAAGATGGTGATGTTGAGAGTGAATGGGAAAATGACGATACTGTTGCAGCTCGAA
```

Fig. 25F

```
ATCAATTATGTAAAGGTAACATTTTCGCCATGGAGATTAATCTCCAGGCTAACCTGTGGAGAAGTTTCCTCTACTCGAACGTGG
CCCTGTACCTGCCCGACTCCTACAAGTACACGCCGACCAACGTCACGCTGCCGACCAACACCAACACCTACGATTACATGAATG
GCAGAGTGACACCTCCCTCGCTGGTAGACGCCTACCTCAACATCGGGGCGCGCTGGTCGCTGGACCCCATGGACAACGTCAAC
CCCTTCAACCACCACCGCAACGCGGGCCTGCGCTACCGCTCCATGCTCCTGGGCAACGGGCGCTACGTGCCCTTCCACATCCAG
GTGCCCCAAAAGTTTTTCGCCATCAAGAGCCTCCTGCTCCTGCCCGGGTCCTACACCTACGAGTGGAACTTCCGCAAGGACGTC
AACATGATCCTGCAGAGCTCCCTAGGCAACGACCTGCGCACGGACGGGGCCTCCATCGCCTTCACCAGCATCAACCTCTACGC
CACCTTCTTCCCCATGGCGCACAACACCGCCTCCACGCTCGAGGCCATGCTGCGCAACGACACCAACGACCAGTCCTTCAACGA
CTACCTCTCGGCGGCCAACATGCTCTACCCCATCCCGGCCAACGCCACCAACGTGCCCATCTCCATCCCCTCGCGCAACTGGGC
CGCCTTCCGCGGATGGTCCTTCACGCGCCTGAAGACCCGCGAGACGCCCTCGCTCGGCTCCGGGTTCGACCCCTACTTCGTCTA
CTCGGGCTCCATCCCCTACCTAGACGGCACCTTCTACCTCAACCACACCTTCAAGAAGGTCTCCATCACCTTCGACTCCTCCGTC
AGCTGGCCCGGCAACGACCGCCTCCTGACGCCCAACGAGTTCGAAATCAAGCGCACCGTCGACGGAGAGGGATACAACGTGG
CCCAGTGCAACATGACCAAGGACTGGTTCCTGGTCCAGATGCTGGCCCACTACAACATCGGCTACCAGGGCTTCTACGTGCCC
GAGGGCTACAAGGACCGCATGTACTCCTTCTTCCGCAACTTCCAGCCCATGAGCCGCCAGGTCGTGGACGAGGTCAACTACAA
GGACTACCAGGCCGTCACCCTGGCCTACCAGCACAACAACTCGGGCTTCGTCGGCTACCTCGCGCCCACCATGCGCCAGGGCC
AGCCCTACCCCGCCAACTACCCCTACCCGCTCATCGGCAAGAGCGCCGTCGCCAGCGTCACCCAGAAAAAGTTCCTCTGCGACC
GGGTCATGTGGCGCATCCCCTTCTCCAGCAACTTCATGTCCATGGGCGCGCTCACCGACCTCGGCCAGAACATGCTCTACGCCA
ACTCCGCCCACGCGCTAGACATGAATTTCGAAGTCGACCCCATGGATGAGTCCACCCTTCTCTATGTTGTCTTCGAAGTCTTCGA
CGTCGTCCGAGTGCACCAGCCCCACCGCGGCGTCATCGAAGCCGTCTACCTGCGCACGCCCTTCTCGGCCGGCAACGCCACCA
CCTAAGCCGCTCTTGCTTCTTGCAAGATGACGGCGGGCTCCGGCGAGCAGGAGCTCAGGGCCATCCTCCGCGACCTGGGCTGC
GGGCCCTGCTTCCTGGGCACCTTCGACAAGCGCTTCCCTGGATTCATGGCCCCGCACAAGCTGGCCTGCGCCATCGTGAACAC
GGCCGGCCGCGAGACCGGGGGCGAGCACTGGCTGGCCTTCGCCTGGAACCCGCGCTCCCACACATGCTACCTCTTCGACCCCT
TCGGGTTCTCGGACGAGCGCCTCAAGCAGATCTACCAGTTCGAGTACGAGGGCCTGCTGCGTCGCAGCGCCCTGGCCACCGA
GGACCGCTGCGTCACCCTGGAAAAGTCCACCCAGACCGTGCAGGGTCCGCGCTCGGCCGCCTGCGGGCTCTTCTGCTGCATGT
TCCTGCACGCCTTCGTGCACTGGCCCGACCGCCCCATGGACAAGAACCCCACCATGAACTTACTGACGGGGGTGCCCAACGGC
ATGCTCCAGTCGCCCCAGGTGGAACCCACCCTGCGCCGCAACCAGGAAGCGCTCTACCGCTTCCTCAATGCCCACTCCGCCTAC
TTTCGCTCCCACCGCGCGCGCATCGAGAAGGCCACCGCCTTCGACCGCATGAATCAAGACATGTAAAAAACCGGTGTGTGTAT
GTGAATGCTTTATTCATAATAAACAGCACATGTTTATGCCACCTTCTCTGAGGCTCTGACTTTATTTAGAAATCGAAGGGGTTCT
GCCGGCTCTCGGCATGGCCCGCGGGCAGGGATACGTTGCGGAACTGGTACTTGGGCAGCCACTTGAACTCGGGGATCAGCAG
CTTGGGCACGGGGAGGTCGGGGAACGAGTCGCTCCACAGCTTGCGCGTGAGTTGCAGGGCGCCCAGCAGGTCGGGCGCGGA
GATCTTGAAATCGCAGTTGGGACCCGCGTTCTGCGCGCGAGAGTTGCGGTACACGGGGTTGCAGCACTGGAACACCATCAGG
GCCGGGTGCTTCACGCTTGCCAGCACCGTCGCGTCGGTGATGCCCTCCACGTCCAGATCCTCGGCGTTGGCCATCCCGAAGGG
GGTCATCTTGCAGGTCTGCCGCCCCATGCTGGGCACGCAGCCGGGCTTGTGGTTGCAATCGCAGTGCAGGGGATCAGCATC
ATCTGGGCCTGCTCGGAGCTCATGCCCGGGTACATGGCCTTCATGAAAGCCTCCAGCTGGCGGAAGGCCTGCTGCGCCTTGCC
GCCCTCGGTGAAGAAGACCCCGCAGGACTTGCTAGAGAACTGGTTGGTGGCGCAGCCGGCGTCGTGCACGCAGCAGCGCGC
GTCGTTGTTGGCCAGCTGCACCACGCTGCGCCCCAGCGGTTCTGGGTGATCTTGGCCCGGTTGGGGTTCTCCTTCAGCGCGC
GCTGCCCGTTCTCGCTCGCCACATCCATCTCGATAGTGTGCTCCTTCTGGATCATCACGGTCCCGTGCAGGCACCGCAGCTTGC
CCTCGGCTTCGGTGCAGCCGTGCAGCCACAGCGCGCAGCCGGTGCACTCCAGTTCTTGTGGGCGATCTGGGAGTGCGAGTG
CACGAAGCCCTGCAGGAAGCGGCCCATCATCGCGGTCAGGGTCTTGTTGCTGGTGAAGGTCAGCGGGATGCCGCGGTGCTCC
TCGTTCACATACAGGTGGCAGATGCGGCGGTACACCTCGCCCTGCTCGGGCATCAGCTGGAAGGCGGACTTCAGGTCGCTCTC
CACGCGGTACCGGTCCATCAGCAGCGTCATCACTTCCATGCCCTTCTCCCAGGCCGAAACGATCGGCAGGCTCAGGGGGTTCT
TCACCGCCATTGTCATCTTAGTCGCCGCCGCCGAGGTCAGGGGGTCGTTCTCGTCCAGGGTCTCAAACACTCGCTTGCCGTCCT
TCTCGATGATGCGCACGGGGGAAAGCTGAAGCCCACGGCCGCCAGCTCCTCCTCGGCCTGCCTTTCGTCCTCGCTGTCCTGG
CTGATGTCTTGCAAAGGCACATGCTTGGTCTTGCGGGGTTTCTTTTTGGGCGGCAGAGGCGGCGGCGATGTGCTGGGAGAGC
GCGAGTTCTCGTTCACCACGACTATTTCTTCTTCTTGGCCGTCGTCCGAGACCACGCGGCGGTAGGCATGCCTCTTCTGGGGCA
GAGGCGGAGGCGACGGGCTCTCGCGGTTCGGCGGGCGGCTGGCAGAGCCCCTTCCGCGTTCGGGGGTGCGCTCCTGGCGGC
GCTGCTCTGACTGACTTCCTCCGCGGCCGGCCATTGTGTTCCTAGGGAGCAACAACAAGCATGGAGACTCAGCCATCGTCG
CCAACATCGCCATCTGCCCCCGCCGCCACCGCCGACGAGAACCAGCAGCAGAATGAAAGCTTAACCGCCCCGCCGCCCAGCCC
CACCTCCGACGCCGCGGCCCCAGACATGCAAGAGATGGAGGAATCCATCGAGATTGACCTGGGCTACGTGACGCCCGCGGAG
CACGAGGAGGAGCTGGCAGCGCGCTTTTCAGCCCCGGAAGAGAACCACCAAGAGCAGCCAGAGCAGGAAGCAGAGAACGA
GCAGAACCAGGCTGGGCACGAGCATGGCGACTACCTGAGCGGGGCAGAGGACGTGCTCATCAAGCATCTGGCCCGCCAATG
CATCATCGTCAAGGACGCGCTGCTCGACCGCGCCGAGGTGCCCCTCAGCGTGGCGGAGCTCAGCCGCGCCTACGAGCGCAAC
```

Fig. 25G

```
CTCTTCTCGCCGCGCGTGCCCCCCAAGCGCCAGCCCAACGGCACCTGTGAGCCCAACCCGCGCCTCAACTTCTACCCGGTCTTC
GCGGTGCCCGAGGCCCTGGCCACCTACCACCTCTTTTTCAAGAACCAAAGGATCCCCGTCTCCTGCCGCGCCAACCGCACCCGC
GCCGACGCCCTGCTCAACCTGGGCCCCGGCGCCCGCCTACCTGATATCACCTCCTTGGAAGAGGTTCCCAAGATCTTCGAGGG
TCTGGGCAGCGACGAGACTCGGGCCGCGAACGCTCTGCAAGGAAGCGGAGAGGAGCATGAGCACCACAGCGCCCTGGTGGA
GTTGGAAGGCGACAACGCGCGCCTGGCGGTCCTCAAGCGCACGGTCGAGCTGACCCACTTCGCCTACCCGGCGCTCAACCTGC
CCCCCAAGGTCATGAGCGCCGTCATGGACCAGGTGCTCATCAAGCGCGCCTCGCCCCTCTCGGAGGAGGAGATGCAGGACCC
CGAGAGTTCGGACGAGGGCAAGCCCGTGGTCAGCGACGAGCAGCTGGCGCGCTGGCTGGGAGCGAGTAGCACCCCCCAGAG
CCTGGAAGAGCGGCGCAAGCTCATGATGGCCGTGGTCCTGGTGACCGTGGAGCTGGAGTGTCTGCGCCGCTTCTTTGCCGAC
GCGGAGACCCTGCGCAAGGTCGAGGAGAACCTGCACTACCTCTTCAGGCACGGGTTCGTGCGCCAGGCCTGCAAGATCTCCA
ACGTGGAGCTGACCAACCTGGTCTCCTACATGGGCATCCTGCACGAGAACCGCCTGGGGCAAAACGTGCTGCACACCACCCTG
CGCGGGGAGGCCCGCCGCGACTACATCCGCGACTGCGTCTACCTGTACCTCTGCCACACCTGGCAGACGGGCATGGGCGTGT
GGCAGCAGTGCCTGGAGGAGCAGAACCTGAAAGAGCTCTGCAAGCTCCTGCAGAAGAACCTCAAGGCCCTGTGGACCGGGTT
CGACGAGCGTACCACCGCCTCGGACCTGGCCGACCTCATCTTCCCCGAGCGCCTGCGGCTGACGCTGCGCAACGGGCTGCCCG
ACTTTATGAGCCAAAGCATGTTGCAAAACTTTCGCTCTTTCATCCTCGAACGCTCCGGGATCCTGCCCGCCACCTGCTCCGCGCT
GCCCTCGGACTTCGTGCCGCTGACCTTCCGCGAGTGCCCCCGCCGCTCTGGAGCCACTGCTACTTGCTGCGCCTGGCCAACTA
CCTGGCCTACCACTCGGACGTGATCGAGGACGTCAGCGGCGAGGGTCTGCTGGAGTGCCACTGCCGCTGCAACCTCTGCACG
CCGCACCGCTCCCTGGCCTGCAACCCCCAGCTGCTGAGCGAGACCCAGATCATCGGCACCTTCGAGTTGCAAGGCCCCGGCGA
CGGCGAGGGCAAGGGGGGTCTGAAACTCACCCCGGGGCTGTGGACCTCGGCCTACTTGCGCAAGTTCGTGCCCGAGGACTAC
CATCCCTTCGAGATCAGGTTCTACGAGGACCAATCCCAGCCGCCCAAGGCCGAGCTGTCGGCCTGCGTCATCACCCAGGGGGC
CATCCTGGCCCAATTGCAAGCCATCCAGAAATCCCGCCAAGAATTTCTGCTGAAAAAGGGCCACGGGGTCTACTTGGACCCCC
AGACCGGAGAGGAGCTCAACCCCAGCTTCCCCCAGGATGCCCCGAGGAAGCAGCAAGAAGCTGAAAGTGGAGCTGCCGCCG
CCGGAGGATTTGGAGGAAGACTGGGAGAGCAGTCAGGCAGAGGAGGAGGAGATGGAAGACTGGGACAGCACTCAGGCAG
AGGAGGACAGCCTGCAAGACAGTCTGGAGGAGGAAGACGAGGTGGAGGAGGCAGAGGAAGAAGCAGCCGCCGCCAGACC
GTCGTCCTCGGCGGAGAAAGCAAGCAGCACGGATACCATCTCCGCTCCGGGTCGGGTCGCGGCGGCCGGGCCCACAGTAG
GTGGGACGAGACCGGGCGCTTCCCGAACCCCACCACCCAGACCGGTAAGAAGGAGCGGCAGGGATACAAGTCCTGGCGGGG
GCACAAAAACGCCATCGTCTCCTGCTTGCAAGCCTGCGGGGGCAACATCTCCTTCACCCGGCGCTACCTGCTCTTCCACCGCGG
GGTGAACTTCCCCCGCAACATCTTGCATTACTACCGTCACCTCCACAGCCCCTACTACTGTTTCCAAGAAGAGGCAGAAACCCA
GCAGCAGCAGAAAACCAGCGGCAGCAGCAGCTAGAAAATCCACAGCGGCGGCAGGTGGACTGAGGATCGCGGCGAACGAG
CCGGCGCAGACCGGGAGCTGAGGAACCGGATCTTTCCCACCCTCTATGCCATCTTCCAGCAGAGTCGGGGGCAGGAGCAGG
AACTGAAAGTCAAGAACCGTTCTCTGCGCTCGCTCACCCGCAGTTGTCTGTATCACAAGAGCGAAGACCAACTTCAGCGCACTC
TCGAGGACGCCGAGGCTCTCTTCAACAAGTACTGCGCGCTCACTCTTAAAGAGTAGCCCGCGCCCGCCCACACACGGAAAAAG
GCGGGAATTACGTCACCACCTGCGCCCTTCGCCCGACCATCATGAGCAAAGAGATTCCCACGCCTTACATGTGGAGCTACCAG
CCCCAGATGGGCCTGGCCGCCGGCGCCGCCCAGGACTACTCCACCCGCATGAACTGGCTCAGTGCCGGGCCCGCGATGATCTC
ACGGGTGAATGACATCCGCGCCCACCGAAACCAGATACTCCTAGAACAGTCAGCGATCACCGCCACGCCCCGCCATCACCTTA
ATCGCGTAATTGGCCCGCCGCCCTGGTGTACCAGGAAATTCCCCAGCCCACGACCGTACTACTTCCGCGAGACGCCCAGGCC
GAAGTCCAGCTGACTAACTCAGGTGTCCAGCTGGCCGGCGGCGCCGCCCTGTGTCGTCACCGCCCCGCTCAGGGTATAAAGCG
GCTGGTGATCCGAGGCAGAGGCACACAGCTCAACGACGAGGTGGTGAGCTCTTCGCTCGGGTCTGCGACCTGACGGAGTCTTC
CAACTCGCCGGATCGGGGAGATCTTCCTTCACGCCTCGTCAGGCCGTCCTGACTTTGGAGAGTTCGTCCTCGCAGCCCCGCTCG
GGCGGCATCGGCACTCTCCAGTTCGTGGAGGAGTTCACTCCCTCGGTCTACTTCAACCCCTTCTCCGGCTCCCCCGGCCACTAC
CCGGACGAGTTCATCCCGAACTTCGACGCCATCAGCGAGTCGGTGGACGGCTACGATTGAATGTCCCATGGTGGCGCAGCTG
ACCTAGCTCGGCTTCGACACCTGGACCACTGCCGCCGCTTCCGCTGCTTCGCTCGGGATCTCGCCGAGTTTGCCTACTTTGAGC
TGCCCGAGGAGCACCCTCAGGGCCCAGCCCACGGAGTGCGGATCATCGTCGAAGGGGCCTCGACTCCCACCTGCTTCGGAT
CTTCAGCCAGCGACCGATCCTGGTCGAGCGCGAACAAGGACAGACCCTTCTTACTTTGTACTGCATCTGCAACCACCCCGGCCT
GCATGAAAGTCTTTGTTGTCTGCTGTGTACTGAGTATAATAAAAGCTGAGATCAGCGACTACTCCGGACTCGATTGTGGTGTTC
CTGCTATCAACCGGTCCCTGTTCTTCACCGGGAACGAGACCGAGCTCCAGCTCCAGTGTAAGCCCCACAAGAAGTACCTCACCT
GGCTGTTCCAGGGCTCCCCGATCGCCGTTGTCAACCACTGCGACAACGACGGAGTCCTGCTGAGCGGCCCTGCCAACCTTACTT
TTTCCACCCGCAGAAGCAAGCTCCAGCTCTTCCAACCCTTCCTCCCCGGGACCTATCAGTGCGTCTCAGGACCCTGCCATCACAC
CTTCCACCTGATCCCGAATACCACAGCGCCGCTCCCCGCTACTAACAACCAAACTACCCACCAACGCCACCGTCGCGACCTTTCC
TCTGAATCTAATACCACTACCGGAGGTGGCTTCTGCTGTTAGTGCTCCCCCGTCCCGTCGACCCCGGTCCCCACTCAGTCCCC
CGAGGAGGTTCGCAAATGCAAATTCCAAGAACCCTGGAAATTCCTCAAATGCTACCGCCAAAAATCAGACATGCATCCCAGCT
GGATCATGATCATTGGGATCGTGAACATTCTGGCCTGCACCCTCATCTCCTTTGTGATTTACCCCTGCTTTGACTTTGGTTGGAA
CTCGCCAGAGGCGCTCTATCTCCCGCCTGAACCTGACACACCACCACAGCAGCAACCTCAGGCACACGCACTACCACCACCACA
GCCTAGGCCACAATACATGCCCATATTAGACTATGAGGCCGAGCCACAGCGACCCATGCTCCCCGCTATTAGTTACTTCAATCT
AACCGGCGGAGATGACTGACCCACTGGCCAATAACAACGTCAACGACCTTCTCCTGGACATGGACGGCCGCGCCTCGGAGCA
GCGACTCGCCCAACTTCGCATTCGTCAGCAGCAGGAGAGAGCCGTCAAGGAGCTGCAGGACGGCATAGCCATCCACCAGTGC
AAGAGAGGCATCTTCTGCCTGGTGAAACAGGCCAAGATCTCCTACGAGGTCACCCAGACCGACCATCGCCTCTCCTACGAGCT
CCTGCAGCAGCGCCAGAAGTTCACCTGCCTGGTCGGAGTCAACCCCATCGTCATCACCCAGCAGTCGGGCGATACCAAGGGGT
```

Fig. 25H

```
GCATCCACTGCTCCTGCGACTCCCCCGACTGCGTCCACACTCTGATCAAGACCCTCTGCGGCCTCCGCGACCTCCTCCCCATGAA
CTAATCACCCCCTTATCCAGTGAAATAAAGATCATATTGATGATGATTTAAATAAAAAAAATAATCATTTGATTTGAAATAAAGA
TACAATCATATTGATGATTTGAGTTTAACAAAAATAAAGAATCACTTACTTGAAATCTGATACCAGGTCTCTGTCCATGTTTTCT
GCCAACACCACCTCACTCCCCTCTTCCCAGCTCTGGTACTGCAGGCCCCGGCGGGCTGCAAACTTCCTCCACACGCTGAAGGGG
ATGTCAAATTCCTCCTGTCCCTCAATCTTCATTTTATCTTCTATCAGATGTCCAAAAAGCGCGTCCGGGTGGATGATGACTTCGA
CCCCGTCTACCCCTACGATGCAGACAACGCACCGACCGTGCCCTTCATCAACCCCCCTTCGTCTCTTCAGATGGATTCCAAGAG
AAGCCCCTGGGGGTGTTGTCCCTGCGACTGGCTGACCCGTCACCACCAAGAACGGGGAAATCACCCTCAAGCTGGGAGAGG
GGGTGGACCTCGACTCGTCGGGAAAACTCATCTCCAACACGGCCACCAAGGCCGCCGCCCCTCTCAGTATTTCAAACAACACC
ATTTCCCTTAAAACTGCTGCCCCTTTCTACAACAACAATGGAACTTTAAGCCTCAATGTCTCCACACCATTAGCAGTATTTCCCAC
ATTTAACACTTTAGGCATAAGTCTTGGAAACGGTCTTCAGACTTCAAATAAGTTGTTGACTGTACAACTAACTCATCCTCTTACA
TTCAGCTCAAATAGCATCACAGTAAAAACAGACAAAGGGCTATATATTAACTCCAGTGGAAACAGAGGACTTGAGGCTAATAT
AAGCCTAAAAAGAGGACTAGTTTTTGACGGTAATGCTATTGCAACATATATTGGAAATGGCTTAGACTATGGATCTTATGATAG
TGATGGAAAAACAAGACCCGTAATTACCAAAATTGGAGCAGGATTAAATTTTGATGCTAACAAAGCAATAGCTGTCAAACTAG
GCACAGGTTTAAGTTTTGACTCCGCTGGTGCCTTGACAGCTGGAAACAAACAGGATGACAAGCTAACACTTTGGACTACCCCT
GACCCAAGCCCTAATTGTCAATTACTTTCAGACAGAGATGCCAAATTTACTCTCTGTCTTACAAAATGCGGTAGTCAAATACTAG
GCACTGTGGCAGTGGCGGCTGTTACTGTAGGATCAGCACTAAATCCAATTAATGACACAGTCAAAAGCGCCATAGTTTTCCTTA
GATTTGATTCCGATGGTGTACTCATGTCAAACTCATCAATGGTAGGTGATTACTGGAACTTTAGGGAGGGACAGACCACTCAA
AGTGTAGCCTATACAAATGCTGTGGGATTCATGCCAAATATAGGTGCATATCCAAAAACCCAAAGTAAAACACCTAAAAATAG
CATAGTCAGTCAGGTATATTTAACTGGAGAAACTACTATGCCAATGACACTAACCATAACTTTCAATGGCACTGATGAAAAAGA
CACAACCCCAGTTAGCACCTACTCTATGACTTTTACATGGCAGTGGACTGGAGACTATAAGGACAAAAATATTACCTTTGCTAC
CAACTCATTCTCTTTTTCCTACATCGCCCAGGAATAATCCCACCCAGCAAGCCAACCCCTTTTCCCACCACCTTTGTCTATATGGA
AACTCTGAAACAGAAAAATAAAGTTCAAGTGTTTTATTGAATCAACAGTTTTACAGGACTCGAGCAGTTATTTTTCCTCCACCCT
CCCAGGACATGGAATACACCACCCTCTCCCCCGCACAGCCTTGAACATCTGAATGCCATTGGTGATGGACATGCTTTTGGTCT
CCACGTTCCACACAGTTTCAGAGCGAGCCAGTCTCGGATCGGTCAGGGAGATGAAACCTCCGGGCACTCCCGCATCTGCACC
TCACAGCTCAACAGCTGAGGATTGTCCTCGGTGGTCGGGATCACGGTTATCTGGAAGAAGCAGAAGAGCGGCGGTGGGAATC
ATAGTCCGCGAACGGGATCGGCCGGTGGTGTCGCATCAGGCCCCGCAGCAGTCGCTGCCGCCGCCGCTCCGTCAAGCTGCTG
CTCAGGGGGTTCGGGTCCAGGGACTCCCTCAGCATGATGCCCACGGCCCTCAGCATCAGTCGTCTGGTGCGGCGGGCGCAGC
AGCGCATGCGAATCTCGCTCAGGTCACTGCAGTACGTGCAACACAGGACCACCAGGTTGTTCAACAGTCCATAGTTCAACACG
CTCCAGCCGAAACTCATCGCGGGAAGGATGCTACCCACGTGGCCGTCGTACCAGATCCTCAGGTAAATCAAGTGGCGCTCCCT
CCAGAAGACGCTGCCCATGTACATGATCTCCTTGGGCATGTGGCGGTTCACCACCTCCCGGTACCACATCACCCTCTGGTTGAA
CATGCAGCCCCGGATGATCCTGCGGAACCACAGGGCCAGCACCGCCCCGCCCGCCATGCAGCGAAGAGACCCCGGATCCCGG
CAATGACAATGGAGGACCCACCGCTCGTACCCGTGGATCATCTGGGAGCTGAACAAGTCTATGTTGGCACAGCACAGGCATAT
GCTCATGCATCTCTTCAGCACTCTCAGCTCCTCGGGGGTCAAAACCATATCCCAGGGCACGGGGAACTCTTGCAGGACAGCGA
ACCCCGCAGAACAGGGCAATCCTCGCACATAACTTACATTGTGCATGGACAGGGTATCGCAATCAGGCAGCACCGGGTGATCC
TCCACCAGAGAAGCGCGGGTCTCGGTCTCCTCACAGCGTGGTAAGGGGGCCGGCCGATACGGGTGATGGCGGGACGCGGCT
GATCGTGTTCTCGACCGTGTCATGATGCAGTTGCTTTCGGACATTTTCGTACTTGCTGTAGCAGAACCTGGTCCGGGCGCTGCA
CACCGATCGCCGGCGGCGGTCTCGGCGCTTGGAACGCTCGGTGTTAAAGTTGTAAAACAGCCACTCTCTCAGACCGTGCAGCA
GATCTAGGGCCTCAGGAGTGATGAAGATCCCATCATGCCTGATAGCTCTGATCACATCGACCACCGTGGAATGGGCCAGGCCC
AGCCAGATGATGCAATTTTGTTGGGTTTCGGTGACGGCGGGGAGGGAAGAACAGGAAGAACCATGATTAACTTTTAATCCA
AACGGTCTCGGAGCACTTCAAAATGAAGGTCACGGAGATGGCACCTCTCGCCCCGCTGTGTTGGTGGAAAATAACAGCCAG
GTCAAAGGTGATACGGTTCTCGAGATGTTCCACGGTGGCTTCCAGCAAAGCCTCCACGCGCACATCCAGAAACAAGACAATAG
CGAAAGCGGGAGGGTTCTCTAATTCCTCAACCATCATGTTACACTCCTGCACCATCCCCAGATAATTTTCATTTTTCCAGCCTTG
AATGATTCGAACTAGTTCCTGAGGTAAATCCAAGCCAGCCATGATAAAAAGCTCGCGCAGAGCACCCTCCACCGGCATTCTTAA
GCACACCCTCATAATTCCAAGATATTCTGCTCCTGGTTCACCTGCAGCAGATTGACAAGCGGAATATCAAAATCTCTGCCGCGA
TCCCTGAGCTCCTCCCTCAGCAATAACTGTAAGTACTCTTTCATATCGTCTCCGAAATTTTTAGCCATAGGACCCCCAGGAATAA
GAGAAGGGCAAGCCACATTACAGATAAACCGAAGTCCCCCCAGTGAGCATTGCCAAATGTAAGATTGAAATAAGCATGCTG
GCTAGACCCGGTGATATCTTCCAGATAACTGGACAGAAAATCGGGTAAGCAATTTTTAAGAAAATCAACAAAAGAAAATCTT
CCAGGTGCACGTTTAGGGCCTCGGGAACAACGATGGAGTAAGTGCAAGGGGTGCGTTCCAGCATGGTTAGTTAGCTGATCTG
TAAAAAAACAAAAAATAAAACATTAAACCATGCTAGCCTGGCGAACAGGTGGGTAAATCGTTCTCTCCAGCACCAGGCAGGCC
ACGGGGTCTCCGGCGCGACCCTCGTAAAAATTGTCGCTATGATTGAAAACCATCACAGAGAGACGTTCCCGGTGGCCGGCGT
GAATGATTCGAGAAGAAGCATACACCCCGGAACATTGGAGTCCGTGAGTGAAAAAAGCGGCCGAGGAAGCAATGAGGCA
CTACAACGCTCACTCTCAAGTCCAGCAAAGCGATGCCATGCGGATGAAGCACAAAATTTTCAGGTGCGTAAAAAATGTAATTA
CTCCCCTCCTGCACAGGCAGCGAAGCTCCCGATCCCTCCAGATACACATACAAAGCCTCAGCGTCCATAGCTTACCGAGCGGCA
GCAGCAGCGGCACACAACAGGCGCAAGAGTCAGAGAAAAGACTGAGCTCTAACCTGTCCGCCCGCTCTCTGCTCAATATATAG
CCCCAGATCTACACTGACGTAAAGGCCAAAGTCTAAAAATACCCGCCAAATAATCACACACGCCCAGCACACGCCCAGAAACC
GGTGACACACTCAGAAAAATACGCGCACTTCCTCAAACGGCCAAACTGCCGTCATTTCCGGGTTCCCACGCTACGTCATCAAAA
CACGACTTTCAAATTCCGTCGACCGTTAAAAACATCACCCGCCCCGCCCCTAACGGTCGCCGCTCCCGCAGCCAATCACCTTCCT
CCCTCCCCAAATTCAAACAGCTCATTTGCATATTAACGCGCACCAAAAGTTTGAGGTATATTATTGATGATG
```

Fig. 25I

AdC6 020-DU422gp160(E1621) Amino acids – SEQ ID NO: 14
**The symbol " * " refers herein to stop codons in the non coding regions**

HHQ*YTSNFWCALICK*AV*IWGGRKVIGCGSGDR*GRGG*RFDDVAMRRSRFASSRGKSDVKRGVV*TRKYSIFPRSLTGNEVFL
GGCK*KRAIFARKLNEEVKI*VISRLWQGGVFAEGRVDFDRLRGGFDYRIFHLNFRVRCQSPVFLRTISFPRKCHLTVTITVLR*RKLRS
PDPLWCTLSTICSDAA*LSQYLLPACVLEVAE*CASKI*ATTRQGLTDNCMKNLLRVRRFALLRDVRARYTR*H*LLTSMPSTPPIDVN
DGKWPAWHYAQYMTLWDFPTWQYIYVLVIAITMVMRFWQYINGRG*RFDSRGFPSLHPIDVNGSLFWHQNQRDFPKCRNNSA
PLTQMGGRRVRWEVYISRARLVNRQITRSFIAVVYHS*IANAVSASDTTVSNLRLEFDATMRVRGIPRNWPQWWIWGILGFWMIII
CRVVGNLDLWVTVYYGVPVWKEAKTTLFCASDAKAYDKEVHNVWATHACVPTDPNPQEIVLENVTENFNMWKNDMVDQMHE
DIISLWDQSLKPCVKLTPLCVTLNCKNVNISANANATATLNSSMNGEIKNCSFNTTTELRDKKQKVYALFYKPDVVPLNGGEHNETGE
YILINCNSSTITQACPKVSFDPIPIHYCAPAGYAILKCNNKTFNGTGPCNNVSTVQCTHGIKPVVSTQLLLNGSLAEEEIVRSENLTNNIK
TIIVHLNKSVEIKCTRPNNNTRKSVRIGPGQTFYATGEIIGDIREAHCNISRETWNSTLIQVKEKLREHYNKTIKFEPSSGGDLEVTTHSF
NCRGEFFYCDTTKLFNETKLFNESEYVDNKTIILPCRIKQIINMWQEVGRAMYAPPIEGNITCKSNITGLLLTWDGGENSTEGVFRPG
GGNMKDNWRSELYKYKVVEIKPLGVAPTKSKRKVVGREKRAVGLGAVLLGFLGAAGSTMGAASITLTVQARQLLSGIVQQQSNLLR
AIEAQQHLLQLTVWGIKQLQTRVLAIERYLKDQQLLGLWGCSGKLICATAVPWNSSWSNKSLGDIWDNMTWMQWDREISNYTN
TIFRLLEDSQNQQEKNEKDLLALDSWKNLWNWFDITNWLWYIKIFIMIVGGLIGLRIIFGVLAIVKRVRQGYSPLSFQTLIPNRGPDR
LGRIEEEGGEQDKDRSIRLVSGFLALAWDDLRSLCLFSYHQLRDFILTAARAAELLGRSSLRGLQRGWEVLKYLGNLVQYWGLELKRS
AINLFDTIAIAVAEGTDRIIEVIQRICRAIRYIPTRIRQGFEAALL*GTSRVDPGGQTADQPRLCLLVASHLLFAPPPCLP*PWKVPLPLSF
PNKMRKLHRIV*VGVILFWGVGWGRTARGRIGKTIAGMLGMRWALWLLRRKEPADLQI*IHLCRVRRKRNGIMGIMGLHIG
QISTYAGHRACGLAPPQDMARVRAQRHDPLQCAPGLPPRHVHALPVQHAICEGAAGARCHVQSEPDGGV*HECGAVENSEI**I
QDQVPGLRMRRQARQASARVCGGDGGPATRSFGVVLQRDGVRLQRGRI*LE*VVFGAGCEPA*GAE*LKSVVFCVLQQHERKRL
L*GRGIQPLSDGASPLLGGSASECDGIHGGRPARAARELFNPDLRDPELLVRGRSCRRSCCFRRQRRARNGPGRRLLQLSGGQLEFH
Q*SRQPERGEAAAADGPARGPDPAPGRADPAGGSAAGGDAGRGCHGENQIKNESINKRRRLLILTQSLESLFDFSRAVGPGPPVSII
EHPVDLFQDPVEVGLDVEVHGHEPVPGVEVAPLQGLVLGDGVVNHPVIAGAQGVVLHDVLEEETDGHGQPLGVGVDEPVELGG
MHAGGDEMHLGLDLEIGDVPAQIPPGVHVVQDHQHGVSGALGEFVMQLGREGVKEFGDALVTAQVFHALIHDDGDGPVGGGL
GKDVSGVGHIVVVVLGELVIGHFNEFGAEGARLGDEGALDPGGVVALADLHLPGLELGGGDHVHLRGDEKNGFRGGGDELGRKQ
VPEQLGLAATGGAVDDPDDRLQVVVEGETAAVLAEEGGHLVHHLAHMHVLAHEFRQEALAPQREELLQRGEVFQRLESVGHGHF
GEGLLQEFQTVPELGDVL*GISIQQTSSFRGLGRLRE*GTRRWASSEARVRSFQGRRVRVSVVSVTVKGCAPGWALARVRFRLIRLV
ENRSRSAPCASAR*QLSMSS*LSASAAWPLARSLPLEVCPQTGQRRDLRA*SLGARKTDSGA*ASAPQLAQTVSHSTSQVRSGRLGS
KTRFPPCFLMRFLPLVSMSSCPRWVTKRLSVSP*TDFMGRSSSGVPRSSS*RNPAHSETKARVQASTKEATWEG*RSLSTSGSTFSR
VCKHMSPSSTSRKVIGL*V*AT*PGVPAGGV*KGAGPCSSSLSSGSLSRSASCWGRYSLSKAGMTSALRLSVSRNEEDLILTVPLETPF
MSPSSIWSEKTIFLLSSLVAKEP*RALESSLAMERMVWFFSLSARSLAAMLSCTYSRATHFHSGKTVVSSSGTILTRQPRLCRVMRSTL
VATSPRRGSLVQQRRPPLREQKGGSGSSMSSSGGSASTVKMPGRSSGSK*LMQVPRLSSAACQSRTASARS*GLRGVPQGMGCV
SAEAYMPQMS*T*RGSSRTPM*VG*QRPPRMLART*SYSSCEGARSPVPRLERCGFSAR*TIWRKMAWELEEMVGLWKMLKWA
WGRPTESLMKWA*ESCSLATSSAVTRTSRAQ*SRVSWMMSYLSWPFCFHSSRLRRNSSRSFQYSSRGNPS*SAR*EPTM*NWLTA
L*AQQPFSTGRA*ACAALRREVWVRAKVSRTMTLRNWCLKSRSSQPPCSQSWKSVRFL*AGLGKAKVTSLKRILPARGMKLRVMR
KGWGTSARLLMTWAARTISSKPLMLCPTM*SSTNRGRPLTWGSFLSSS*VSSAGSLSPCCSRAQSATWGLALRKEVQRSTARAVCK
RSRY*RNCWPTAIFSGVTQ*KVRGSPCQRSHLSWRARSWASSTSGGSPESFMTSMKGTSCLPKDPIQV*VSTS*VRKSLSVRGCEP
MGKNWISCHQLEEWLLM*WK*KCRRRAEHSCLCLYKRPQCSQRCTGCTCCTSCTWVPLARNFSGQWSAGGCISCCTTSWPSAW
PSSASMVVMLTSPRGRQVQTSARTGRRARTRARRPELSRVLRRCGVRSVGSGGARLTCRSFSRARGRSRWYLISTAPLVATSTACRV
PCPWGATTVPRFFLGAASMSVRSGGEDARRAAGAARGPEAGAAGARRRARAGSGTAPGEDWRERRRDG*RPGSDASG*RPR
DP*V*T*KRVRQNQSRYR*RRPAAGSLARRPSCPGRRSRS*TARSPPPEGLRGRRARRWPRGRWRCGP*AARRRSCRPRSRRGCR
PRLRRGRARA*PPGRG*ARRGA*RPRSCRGAGRGS*AWWRCAR*RRST*SSGGAASR*RRPGLPSVPWPRRSPRRS*KTGSCAPR
RSTPPPEDG*ARRWWRAPRARRPRGAPLPSPPLPPPLTSLLLPPQEAVAGEGPCVAGGARADGR*SARW5PRAGDAWSR*RRAR
PRGAAA*RRRRASPGGRRGGLRWAGRGR*RCILSIDP*GLRART*ASRDPRDPKTAERRLRASRSRKVG*ARFLVLRVFGREAGGRC
CW**S*SRRS*DGGWWRGAPGPWARLAGCADGRPCPRRGPDTWRGPCSSPA*AAPRAPPPRPRGRACA*ARTRAAAGRAPGR
RRRAR*GWPAGSG*GWSGSRRS*RRSGGRLRC*WCRSSWP*RTS*RSGGRVARARGT*GASRRACRRCSRCRRARGTGIRRGSAA
AAGGRAAIARWGRRARGPRA*GGGSRRCTWTSR*CRRRWWRRAGTRGRGSRCCAAAGSSSWWPRSGP*GARSRGCSRHTG
KNESGQRLDSVAWRLSERVGLRVYPGSNLESGWSRS*RGTGTPVSTQAC*RNLQDTEAGRFLALVAGHEKLVSAESGRPRWLAAV
VWRKNRQGCVAVCPGSSLSARRRPDSAANVGVAAPSFPRPLSQPTSPVTERAPLFFSCVFARCIPYCGRCAPTLHHNRPYRSSSNSR
RFCPRPSSSQPLPRRPP*AEPAFSMTWPWKRARGWRGWGRRRRSGTRACR*KGTLARPTCPSRTCSETGAARSPRRCAPPASTRG

Fig. 25J

```
GSCGAAWTESGC*GTRISRRTS*RGSAPRARTWPRPTWSRRTSRP*RRRATSKNPSTTTCAR*SRARR*PWA*CTCGTCWRPSCR
TPRASR*RRSCFWWCSTVGTTRRSGRRC*ISPSPRAAGSWTW*TFCRASWCRSAGCRCPRSWRPSTSRC*VWASTTLGRSTRPRT
CP*TRR*RSTGFTCA*P*KC*P*ATIWGCTATTGCTAR*APAAGAS*ATRS*CTACSGP*PGPGPRGRATLTWARTCAGSPAAGPW
KLPAVPPTWRRWTMRRRRASTWKTDGATVFLLDAATATAAAS*SRDAGGAAEPAVRH*LLGRLDPGHATHHGADDPQSRSL*TA
ASGQPALGHPGGRGALALEPHAREGAGHRERAGGEQGHPR*RGRAGVQRAAGARGPLQQHQRADEPGPHGDRRARGGVAAR
AVPPRVEPGLHGGAERLPEHAARQRAPGPGGLHQLHQRAAADGGRGAPERGVPVGAGLLLPDQSPGLADREPEPGFQELAGTVG
RAGPGRGPRDGVEPADAELAPAAAAGGALHGQRQREPRLVPGLPA*PVPRGHRTGARGRADLPGDHPREPRAGPGGPGQPGG
HPELPADQPVAEDPAPVRAEHRGGAHPALRAAERGAVPDAGGGHAQRGARHDRAQHGAQHVRPQPPVHQ*ADGLLASGGRH
ELGLLYQRHLEPALAPAARVLHGRVRHARPQRRVPVGRRGQQRVLAASRNQCRVEERGRGPAAVLGAVRSRGCCRGGARGRQPL
PEPALFAEQRAQQRAGSADATAPAGRGGVPERLLVEARAREELPQ*RDREPGGQDEPLEDVRARAQGRAPS*QRRHP*TPAARQ
AAGTGVGR*GFRRRQQRVGLGWEWW*PVRSPAPPYRAPDVRI*KNKRRYSPRPWRPACVLLCCL**YDEARVPGGSSSLVRERD
AAGGGGGDAAPAGGALRAPAVPGAYGGAEQHSLLGAGTLVRYHPVVPGGQQVGRHRLAELPERPQQLPDHRGAEQRFHPHGG
QHPDHQL*RALAVGRPAENHHAHQHAQRERVHVQQQVQGAGDGLAQDPQRGG**L*W*SGRADLRVGGV*AARGQLLGDH
DHRSDEQRHHRQLLGGGAAERGAGERHRREVRHAQLPAGLGPRDRAGDAGRVHQRGLPPRHRPAARLRRGLHREPPQQPAGH
PQAAALPGGLPDPVRGPGGGQHPRALGCRSLREKQGG*HRRGDRSRGHRLYRGAGR*FC*RCGSGRGG*NRK*DSHPAGGEGQ
QGGQELQRARGGQEKHRLPQLVPGLQLRRPREGRALLDAAHHLGRHLRRGASLLVAARHDARPGHLPLHASS*QLPGGGRRAPARLL
QELLQRAGRLLAAAARLHLAHARLQPLPREPDPRPPARAHHYHRQ*KRSCSHRSRDPAAAQQYPGSPARDRH*RQTPHLPLRLQG
PGRSRAARPLEPHLLKNVHSHLAQ**HRLGPARAQQDVRRRSPTLHATPRARARALPRSLGRPQGPRALAHHRRRRDRPGGGRRA
QLHARRRARLHRGRRHRQRGGRRAPVRPHQEPAAAHRPAAPEHPRHARGASLAAQGQAHGTQGHAQGGQTRGLRQQQRRQD
PQTRGHGGGGGHRQHVPPAARQRVLGARRRHRCARARAHPPSHLKMLTSRC*CVPAARRMSKRKYKEEMLQVIAPEIYGPAAA
VKEERKPRKLKRVKKDKKEEEDDGLVEFVREFAPRRRVQWRGRKVKPVLRPGTTVVFTPGERSGSASKRSYDEVYGDEDILEQAVER
LGEFAYGKRSRPAPLKEEAVSIPLDHGNPTPSLKPVTLQQVLPSAAPRRGFKREGGEDLYPTMQLMVPKRQKLEDVLEHMKVDPEV
QPEVKVRPIKQVAPGLGVQTVDIKIPTEPMETQTEPVKPSTSTMEVQTDPWMPAPASTSTRRRRKYGAASLLMPNYALHPSIPTPG
YRGTRFYRGYTSSRRRKTTTRRRRRSRRSSTATSALVRRVYRSGREPLTLPRARYHPSIAI*LPPPTCRYGPHMPPPRPHYGLPRKKAAP
*KADGERAASPSPPAAARHQQAVGGRLPARADPHHRRGDRGDPRHSFRGGAGLSAPLRHKKAWICNKKKNGLTLLVL*CVFLDGR
HQFFVPGTATRHAAVYGHLERHRQQPTERGRLQLEQSLERA*EFRVHAQNLWQQGVEQQHRAGAEGKAERTELPAEGG*WPGL
RHQRGG*PGQPGRAETDQQPPGRGPARGVRGDAPGGGAASPGQARRQATASRRGGDAADAHGRAAPVRGGGETGPAHHA
ARGASGHRSAETQQQPARDPGLASASPLHSG*APAAGGRRVARPPRPPPGELAEHSEQHRGSGSAECEAPPLLLKDTVALNLLVCV
YMYVRRPEGGV*RGASPSCKMATPSMLPQWAYMHIAGQDASEYLSPGLVQFARATDTYFSLGNKFRNPTVAPTHDVTTDRSQRL
TLRFVPVDREDNTYSYKVRYTLAVGDNRVLDMASTYFDIRGVLDRGPSFKPYSGTAYNSLAPKGAPNSSQWEQAKTGNGGTMETH
TYGVAPMGGENITKDGLQIGTDVTANQNKPIYADKTFQPEPQVGEENWQETENFYGGRALKKDTNMKPCYGSYARPTNEKGGQ
AKLKVGDDGVPTKEFDIDLAFFDTPGGTVNGQDEYKADIVMYTENTYLETPDTHVVYKPGKDDASSEINLVQQSMPNRPNYIGFRD
NFIGLMYYNSTGNMGVLAGQASQLNAVVDLQDRNTELSYQLLLDSLGDRTRYFSMWNQAVDSYDPDVRIIENHGVEDELPNYCFP
LDGSGTNAAYQGVKVKDGQDGDVESEWENDDTVAARNQLCKGNIFAMEINLQANLWRSFLYSNVALYLPDSYKYTPTNVTLPTN
TNTYDYMNGRVTPPSLVDAYLNIGARWSLDPMDNVNPFNHHRNAGLRYRSMLLGNGRYVPFHIQVPQKFFAIKSLLLLPGSYTYE
WNFRKDVNMILQSSLGNDLRTDGASIAFTSINLYATFFPMAHNTASTLEAMLRNDTNDQSFNDYLSAANMLYPIPANATNVPISIPS
RNWAAFRGWSFTRLKTRETPSLGSGFDPYFVYSGSIPYLDGTFYLNHTFKKVSITFDSSVSWPGNDRLLTPNEFEIKRTVDGEGYNVA
QCNMTKDWFLVQMLAHYNIGYQGFYVPEGYKDRMYSFFRNFQPMSRQVVDEVNYKDYQAVTLAYQHNNSGFVGYLAPTMRQ
GQPYPANYPYPLIGKSAVASVTQKKFLCDRVMWRIPFSSNFMSMGALTDLGQNMLYANSAHALDMNFEVDPMDESTLLYVVFEV
FDVVRVHQPHRGVIEAVYLRTPFSAGNATT*AALASCKMTAGSGEQELRAILRDLGCGPCFLGTFDKRFPGFMAPHKLACAIVNTA
GRETGGEHWLAFAWNPRSHTCYLFDPFGFSDERLKQIYQFEYEGLLRRSALATEDRCVTLEKSTQTVQGPRSAACGLFCCMFLHAFV
HWPDRPMDKNPTMNLLTGVPNGMLQSPQVEPTLRRNQEALYRFLNAHSAYFRSHRARIEKATAFDRMNQDM*KTGVCM*MLY
S**TAHVYATFSEALTLFRNRRGSAGSRHGPRAGIRCGTGTWAAT*TRGSAAWARGGRGTSRSTACA*VAGRPAGRARRS*NRS
WDPRSARESCGTRGCSTGTPSGPGASRLPAPSRR*CPPRPDPRRWPSRRGSSCRSAAPCWARSRACGCNRSAGGSASSGPARSSC
PGTWPS*KPPAGGRPAAPCRPR*RRPRRTC*RTGWWRSRRRARSSARRCWPAAPRCAPSGSG*SWPGWGSPSARAARSRSPHP
SR*CAPSGSSRSRAGTAACPRLRCSRAATARSRCTPSSCGRSGSASARSPAGSGPSSRSGSCCW*RSAGCRGAPRSHTGGRCGGTP
RPARASAGRRTSGRSPRGTGPSAASSLPCPSPRPKRSAGSGGSSPPLSS*SPPPRSGGRSRPGSQTLACRPSR*CARGES*SPRPPAPP
RPAFRPRCPG*CLAKAHAWSCGVSFWAAEAAAMCWESASSRSPRLFLLLGRRPRPRGGRHASSGAEAEATGSRGSAGGWQSPFR
VRGCAPGGAALTDFLRGRPLCSPREQQQAWRLSHRRQHRHLPPPPPPTRTSSRMKA*PPRRPAPPPTPRPQTCKRWRNPSRLTW
AT*RPRSTRRSWQRAFQPRKRTTKSSQSRKQRTSRTRLGTSMATT*AGQRTCSSSIWPANASSSRTRCSTAPRCPSAWRSSAAPTS
ATSSRRACPPSASPTAPVSPTRASTSTRSSRCPRPWPPTTSFSRTKGSPSPAAPTAPAPTPCSTWAPAPAYLISPPWKRFPRSSRVWA
```

Fig. 25K

ATRLGPRTLCKEAERSMSTTAPWWSWKATTRAWRSSSARSS*PTSPTRRSTCPPRS*APSWTRCSSSAPRPSRRRRCRTPRVRTRA
SPWSATSSWRAGWERVAPPRAWKSGASS*WPWSW*PWSWSVCAASLPTRRPCARSRRTCTTSSGTGSCARPARSPTWS*PTW
SPTWASCTRTAWGKTCCTPPCAGRPAATTSATASTCTSATPGRRAWACGSSAWRSRT*KSSASSCRRTSRPCGPGSTSVPPPRTW
PTSSSPSACG*RCATGCPTL*AKACCKTFALSSSNAPGSCPPPAPRCPRTSCR*PSASAPRRSGATATCCAWPTTWPTTRT*SRTSAA
RVCWSATAAATSARRTAPWPATPSC*ARPRSSAPSSCKAPATARARGV*NSPRGCGPRPTCASSCPRTTIPSRSGSTRTNPSRPRPS
CRPASSPRGPSWPNCKPSRNPAKNFC*KRATGSTWTPRPERSSTPASPRMPRGSSKKLKVELPPPEDLEEDWESSQAEEEEMEDW
DSTQAEEDSLQDSLEEEDEVEEAEEEAAAARPSSSAEKASSTDTISAPGRGRGGRAHSRWDETGRFPNPTTQTGKKERQGYKSWRG
HKNAIVSCLQACGGNISFTRRYLLFHRGVNFPRNILHYYRHLHSPYYCFQEEAETQQQQKTSGSSS*KIHSGGRWTEDRGERAGADP
GAEEPDLSHPLCHLPAESGAGAGTESQEPFSALAHPQLSVSQERRPTSAHSRGRRGSLQQVLRAHS*RVARARPHTEKGGNYVTTC
ALRPTIMSKEIPTPYMWSYQPQMGLAAGAAQDYSTRMNWLSAGPAMISRVNDIRAHRNQILLEQSAITATPRHHLNPRNWPAAL
VYQEIPQPTTVLLPRDAQAEVQLTNSGVQLAGGAALCRHRPAQGIKRLVIRGRGTQLNDEVVSSSLGLRPDGVFQLAGSGRSSFTPR
QAVLTLESSSSQPRSGGIGTLQFVEEFTPSVYFNPFSGSPGHYPDEFIPNFDAISESVDGYD*MSHGGAADLARLRHLDHCRRFRCFA
RDLAEFAYFELPEEHPQGPAHGVRIIVEGGLDSHLLRIFSQRPILVEREQGQTLLTLYCICNHPGLHESLCCLLCTEYNKS*DQRLLRTRL
WCSCYQPVPVLHRERDRAPAPV*APQEVPHLAVPGLPDRRCQPLRQRRSPAERPCQPYFFHPQKQAPALPTLPPRDLSVRLRTLPS
HLPPDPEYHSAAPRY*QPNYPPTPPSRPFL*I*YHYRRWLLLLVLPRPVDPRSPTQSPEEVRKCKFQEPWKFLKCYRQKSDMHPSWI
MIIGIVNILACTLISFVIYPCFDFGWNSPEALYLPPEPDTPPQQQPQAHALPPPQPRPQYMPILDYEAEPQRPMLPAISYFNLTGGDD
*PTGQ*QRQRPSPGHGRPRLGAATRPTSHSSAAGESRQGAAGRHSHPPVQERHLLPGETGQDLLRGHPDRPSPLLRAPAAAPEVH
LPGRSQPHRHHPAVGRYQGVHPLLLRLPRLRPHSDQDPLRPPRPPPHELITPLSSEIKIILMMI*IKKIII*FEIKIQSY**FEFNKNKESLT
*NLIPGLCPCFLPTPPHSPLPSSGTAGPGGLQTSSTR*RGCQIPPVPQSSFYLLSDVQKARPGG**LRPRLPLRCRQRTDRALHQPPLR
LFRWIPREAPGGVVPATG*PRHHQERGNHPQAGRGGGPRLVGKTHLQHGHQGRRPSQYFKQHHFP*NCCPFLQQQWNFKPQC
LHTISSISHI*HFRHKSWKRSSDFK*VVDCTTNSSSYIQLK*HHSKNRQRAIY*LQWKQRT*G*YKPKKRTSF*R*CYCNIYWKWLRL
WIL***WKNKTRNYQNWSRIKF*C*QSNSCQTRHRFKF*LRWCLDSWKQTG*QANTLDYP*PKP*LSITFRQRCQIYSLSYKMR*S
NTRHCGSGGCYCRISTKSN**HSQKRHSFP*I*FRWCTHVKLINGR*LLEL*GGTDHSKCSLYKCCGIHAKYRCISKNPK*NT*K*HSQ
SGIFNWRNYYANDTNHNFQWH**KRHNPS*HLLYDFYMAVDWRL*GQKYYLCYQLILFFLHRPGIIPPSKPTPFPTTFVYMETLKQK
NKVQVFY*INSFTGLEQLFFLHPPRTWNTPPSPPAQP*TSECHW*WTCFWSPRSTQFQSEPVSDRSGR*NPPGTPASAPHSSTAED
CPRWSGSRLSGRSRRAAVGIIVRERDRPVVSHQAPQQSLPPPLRQAAAQGVRVQGLPQHDAHGPQHQSSGAAGAAAHANLAQV
TAVRATQDHQVVQQSIVQHAPAETHRGKDATHVAVVPDPQVNQVALPPEDAAHVHDLLGHVAVHHLPVPHHPLVEHAAPDDP
AEPQGQHRPARHAAKRPRIPAMTMEDPPLVPVDHLGAEQVYVGTAQAYAHASLQHSQLLGGQNHIPGHGELLQDSEPRRTGQSS
HITYIVHGQGIAIRQHRVILHQRSAGLGLLTAW*GGRPIRVMAGRG*SCSRPCHDAVAFGHFRTCCSRTWSGRCTPIAGGGLGAW
NARC*SCKTATLSDRAADLGPQERSHHAL*SHRPPWNGPGPAR*CNFVGFR*RRGREEQEEP*LTFNPNGLGALQNEGHGD
GTSRPCVGGK*QPGQR*YGSRDVPRWLPAKPPRAHPETRQ*RKREGSLIPQPSCYTPAPSPDNFHFSSLE*FELVPEVNPSQP**K
ARAEHPPPAFLSTPS*FQDILLLVHLQQIDKRNIKISAAIPELLPQQ*L*VLFHIVSEIFSHRTPRNKRRASHITDKPKSPPVSIAKCKIEIS
MLARPGDIFQITGQKIG*AIFKKINKRKIFQVHV*GLGNNDGVSARGAFQHG*LADL*KNKK*NIKPC*PGEQVGKSFSPAPGRPRG
LRRDPRKNCRYD*KPSQRDVPGGRRE*FEKKHTPPEHWSP*VKKSGRGSNEALQRSLSSPAKRCHADEAQNFQVRKKCNYSPPAQ
AAKLPIPPDTHTKPQRP*LTERQQQRHTTGARVREKTEL*PVRPLSAQYIAPDLH*RKGQSLKIPAK*SHTPSTRPETGDTLRKIRALP
QTAKLPSFPGSHATSSKHDFQIPSTVKNITRPAPNGRRSRSQSPSSLPKFKQLICILTRTKSLRYIIDD

Fig. 26A

AdC7 010-DU172gp160(E1622) Nucleic Acids – SEQ ID NO: 7

```
CATCATCAATAATATACCTCAAACTTTTGGTGCGCGTTAATATGCAAATGAGCTGTTTGAATTTGGGGAGGGAGGAAGGTGAT
TGGCCGAGAGACGGGCGACCGTTAGGGGCGGGGCGGGTGACGTTTTGATGACGTGGCCGTGAGGCGGAGCCGGTTTGCAA
GTTCTCGTGGGAAAAGTGACGTCAAACGAGGTGTGGTTTGAACACGGAAATACTCAATTTTCCCGCGCTCTCTGACAGGAAAT
GAGGTGTTTCTGGGCGGATGCAAGTGAAAACGGGCCATTTTCGCGCGAAAACTGAATGAGGAAGTGAAAATCTGAGTAATTT
CGCGTTTATGGCAGGGAGGAGTATTTGCCGAGGGCCGAGTAGACTTTGACCGATTACGTGGGGGTTTCGATTACCGTATTTTT
CACCTAAATTTCCGCGTACGGTGTCAAAGTCCGGTGTTTTTACGTACGATATCATTTCCCCGAAAGTGCCACCTGACCGTAACTA
TAACGGTCCTAAGGTAGCGAAAGCTCAGATCTCCCGATCCCCTATGGTGCACTCTCAGTACAATCTGCTCTGATGCCGCATAGT
TAAGCCAGTATCTGCTCCCTGCTTGTGTGTTGGAGGTCGCTGAGTAGTGCGCGAGCAAAATTTAAGCTACAACAAGGCAAGGC
TTGACCGACAATTGCATGAAGAATCTGCTTAGGGTTAGGCGTTTTGCGCTGCTTCGCGATGTACGGGCCAGATATACGCGTTG
ACATTGATTATTGACTAGTATGCCAAGTACGCCCCTATTGACGTCAATGACGGTAAATGGCCCGCCTGGCATTATGCCCAGTA
CATGACCTTATGGGACTTTCCTACTTGGCAGTACATCTACGTATTAGTCATCGCTATTACCATGGTGATGCGGTTTTGGCAGTAC
ATCAATGGGCGTGGATAGCGGTTTGACTCACGGGGATTTCCAAGTCTCCACCCCATTGACGTCAATGGGAGTTTGTTTTGGCA
CCAAAATCAACGGGACTTTCCAAAATGTCGTAACAACTCCGCCCCATTGACGCAAATGGGCGGTAGGCGTGTACGGTGGGAG
GTCTATATAAGCAGAGCTCGTTTAGTGAACCGTCAGATCACTAGAAGCTTTATTGCGGTAGTTTATCACAGTTAAATTGCTAAC
GCAGTCAGTGCTTCTGACACAACAGTCTCGAACTTAAGGCTAGAGTACTTAATACGACTCACTATAGGCTAGTTAAGGCTAGA
GTTCGACGCCACCATGCGCGTGATGGGCATCCTGCGCTCCTACCAGCAGTGGTGGATCTGGGGCATCCTGGGCTTCTGGATGC
TGATGATCTGCAACGTGTGGGGCAACCTGTGGGTGACCGTGTACTACGGCGTGCCCGTGTGGAAGGAGGCCAAGACCACCCT
GTTCTGCGCCTCCGACGCCAAGGCCCACAAGGAGGAGGTGCACAACATCTGGGCCACCCACGCCTGCGTGCCCACCGACCCCA
ACCCCCAGGAGATCGTGCTGAAGAACGTGACCGAGAACTTCAACATGTGGAAGAACGACATGGTGGACCAGATGCACGAGG
ACATCATCTCCCTGTGGGACCAGTCCCTGAAGCCCTGCGTGAAGCTGACCCCCCTGTGCGTGACCCTGAACTGCTCCGACGTGA
AGATCAAGGGCACCAACGCCACCTACAACAACGCCACCTACAACAACAACAACACCATCTCCGACATGAAGAACTGCTCCTTCA
ACACCACCACCGAGATCACCGACAAGAAGAAGAAGGAGTACGCCCTGTTCTACAAGCTGGACGTGGTGGCCCTGGACGGCAA
GGAGACCAACTCCACCAACTCCTCCGAGTACCGCCTGATCAACTGCAACACCTCCGCCGTGACCCAGGCCTGCCCCAAGGTGTC
CTTCGACCCCATCCCCATCCACTACTGCGCCCCCGCCGGCTACGCCATCCTGAAGTGCAACAACAAGACCTTCAACGGCACCGG
CCCCTGCAACAACGTGTCCACCGTGCAGTGCACCCACGGCATCAAGCCCGTGGTGTCCACCCAGCTGCTGCTGAACGGCTCCCT
GGCCGAGGAGGAGGTGGTGATCCGCTTCGAGAACCTGACCAACAACGCCAAGATCATCATCGTGCACCTGAACGAGTCCGTG
GAGATCAACTGCACCCGCCCCTCCAACAACACCCGCAAGTCCGTGCGCATCGGCCCCGGCCAGACCTTCTTCGCCACCGGCGA
CATCATCGGCGACATCCGCCAGGCCCACTGCAACATCTCCCGCAAGAAGTGGAACACCACCCTGCAGCGCGTGAAGGAGAAG
CTGAAGGAGAAGTTCCCCAACAAGACCATCCAGTTCGCCCCCTCCTCCGGCGGCGACCTGGAGATCACCACCCACTCCTTCAAC
TGCCGCGGCGAGTTCTTCTACTGCTACACCTCCGACCTGTTCAACTCCACCTACATGTCCAACAACACCGGCGGCGCCAACATC
ACCCTGCAGTGCCGCATCAAGCAGATCATCCGCATGTGGCAGGGCGTGGGCCAGGCCATGTACGCCCCCCCCATCGCCGGCA
ACATCACCTGCAAGTCCAACATCACCGGCCTGCTGCTGACCCGCGACGGCGGCAAGGAGAAGAACGACACCGAGACCTTCCG
CCCCGGCGGCGGCGACATGCGCGACAACTGGCGCTCCGAGCTGTACAAGTACAAGGTGGTGGAGATCAAGCCCCTGGGCATC
GCCCCCGACAAGGCCAAGCGCCGCGTGGTGGAGCGCGAGAAGCGCGCCGTGGGCATCGGCGCCGTGTTCCTGGGCTTCCTG
GGCGCCGCCGGCAGCACCATGGGCGCCGCCAGCATGACCCTGACCGTGCAGGCCCGCCAGCTGCTGAGCGGCATCGTGCAGC
AGCAGAGCAACCTGCTGCGCGCCATCGAGGCCCAGCAGCACATGCTGCAGCTGACCGTGTGGGGCATCAAGCAGCTGCAGAC
CGCGTGCTGGCCATCGAGCGCTACCTGAAGGACCAGCAGCTGCTGGGCATCTGGGGCTGCAGCGGCAAGCTGATCTGCACC
ACCGCCGTGCCCTGGAACGCCAGCTGGAGCAACAAGAGCTACGAGGAGATCTGGGGCAACATGACCTGGATGCAGTGGGAC
CGCGAGATCAACAACTACACCAACACCATCTACAGCCTGCTGGAGGAGAGCCAGAACCAGCAGGAGAAGAACGAGAAGGAC
CTGCTGGCCCTGGACAGCTGGGAGAGCCTGTGGAGCTGGTTCAACATCACCAACTGGCTGTGGTACATCCGCATCTTCATCAT
CATCGTGGGCGGCCTGATCGGCCTGCGCATCATCTTCGCCGTGCTGAGCATCGTGAACCGCGTGCGCCAGGGCTACAGCCCCC
TGAGCTTCCAGACCCTGACCCCCAGCCCCGCGAGCCCGACCGCCTGGGCCGCATCGAGGAGGGGCGGCGAGCAGGACC
GCGCCCGCAGCGTGCGCCTGGTGAACGGCTTCCTGGCCCTGGCCTGGGAGGACCTGCGCAGCCTGTGCCTGTTCAGCTACCAC
CGCCTGCGCGACCTGATCCTGATCGCCGCCCGCGCCGCCGCCCTGCTGGGCCGCAGCAGCCTGTGGGGCCTGCAGAAGGGCT
GGGAGGCCCTGAAGTACCTGGGCAGCCTGGTGCAGTACTGGGGCCTGGAGCTGAAGAAGAGCGCCATCAGCCTGTTCGACG
CCATCGCCATCACCGTGGCCGAGGGCACCGACCGCATCATCAACATCGTGCAGCGCATCAGCCGCGCCTTCTACAACATCCCCC
GCCGCATCCGCCAGGGCTTCGAGGCCACCCTGCAGTAAGGTACCTCTAGAGTCGACCCGGCGGCCAAACCGCTGATCAGCCT
CGACTGTGCCTTCTAGTTGCCAGCCATCTGTTGTTTGCCCCTCCCCCGTGCCTTCCTTGACCCTGGAAGGTGCCACTCCCACTGT
CCTTTCCTAATAAAATGAGGAAATTGCATCGCATTGTCTGAGTAGGTGTCATTCTATTCTGGGGGGTGGGGTGGGGCAGGACA
```

Fig. 26B

```
GCAAGGGGGAGGATTGGGAAGACAATAGCAGGCATGCTGGGGATGCGGTGGGCTCTATGGCTTCTGAGGCGGAAAGAACC
AGCAGATCTGCAGATCTGAATTCATCTATGTCGGGTGCGGAGAAAGAGGTAATGAAATGGCATTATGGGTATTATGGGTCTGC
ATTAATGAATCGGCCAGATATCGATATGCTGGCCACCGTGCATGTGACCTCGCACCCCCGCAAGACATGGCCCGAGTTCGAGC
ACAACGTCATGACCCGATGCAATGTGCACCTGGGGTCCCGCCGAGGCATGTTCATGCCCTACCAGTGCAACATGCAATTTGTG
AAGGTGCTGCTGGAGCCCGATGCCATGTCCAGAGTGAGCCTGACGGGGGTGTTTGACATGAATGTGGAGCTGTGGAAAATTC
TGAGATATGATGAATCCAAGACCAGGTGCCGGGCCTGCGAATGCGGAGGCAAGCACGCCAGGCTTCAGCCCGTGTGTGTGGA
GGTGACGGAGGACCTGCGACCCGATCATTTGGTGTTGTCCTGCAACGGGACGGAGTTCGGCTCCAGCGGGGAAGAATCTGAC
TAGAGTGAGTAGTGTTTGGGGGAGGTGGAGGGCTTGTATGAGGGGCAGAATGACTAAAATCTGTGTTTTTCTGTGTGTTGCA
GCAGCATGAGCGGAAGCGCCTCCTTTGAGGGAGGGGTATTCAGCCCTTATCTGACGGGGCGTCTCCCCTCCTGGGCGGGAGT
GCGTCAGAATGTGATGGATCCACGGTGGACGGCCGGCCCGTGCAGCCCGCGAACTCTTCAACCCTGACCTACGCGACCCTG
AGCTCCTCGTCCGTGGACGCAGCTGCCGCCGCAGCTGCTGCTTCCGCCGCCAGCGCCGTGCGCGGAATGGCCCTGGGCGCCG
GCTACTACAGCTCTCTGGTGGCCAACTCGACTTCCACCAATAATCCCGCCAGCCTGAACGAGGAGAAGCTGCTGCTGCTGATG
GCCCAGCTCGAGGCCCTGACCCAGCGCCTGGGCGAGCTGACCCAGCAGGTGGCTCAGCTGCAGGCGGAGACGCGGGCCGCG
GTTGCCACGGTGAAAACCAAATAAAAAATGAATCAATAAATAAACGGAGACGGTTGTTGATTTTAACACAGAGTCTTGAATCT
TTATTTGATTTTTCGCGCGCGGTAGGCCCTGGACCACCGGTCTCGATCATTGAGCACCCGGTGGATTTTTCCAGGACCCGGTA
GAGGTGGGCTTGGATGTTGAGGTACATGGGCATGAGCCCGTCCCGGGGGTGGAGGTAGCTCCATTGCAGGGCCTCGTGCTC
GGGGGTGGTGTTGTAAATCACCCAGTCATAGCAGGGGCGCAGGGCGTGGTGCTGCACGATGTCCTTGAGGAGGAGACTGAT
GGCCACGGGCAGCCCCTTGGTGTAGGTGTTGACGAACCTGTTGAGCTGGGAGGGATGCATGCGGGGGGAGATGAGATGCAT
CTTGGCCTGGATCTTGAGATTGGCGATGTTCCCGCCCAGATCCCGCCGGGGGTTCATGTTGTGCAGGACCACCAGCACGGTGT
ATCCGGCGCACTTGGGGAATTTGTCATGCAACTTGGAAGGGAAGGCGTGAAAGAATTTGGAGACGCCCTTGTGACCGCCCAG
GTTTTCCATGCACTCATCCATGATGATGGCGATGGGCCCGTGGGCGGCGGCCTGGGCAAAGACGTTTCGGGGGTCGGACACA
TCGTAGTTGTGGTCCTGGGTGAGCTCGTCATAGGCCATTTTAATGAATTTGGGCGGAGGGTGCCCGACTGGGGACGAAGG
TGCCCTCGATCCCGGGGGCGTAGTTGCCCTCGCAGATCTGCATCTCCCAGGCCTTGAGCTCGGAGGGGGGATCATGTCCACC
TGCGGGGCGATGAAAAAAACGGTTTCCGGGGCGGGGAGATGAGCTGGGCCGAAAGCAGGTTCCGGAGCAGCTGGGACTT
GCCGCAGCCGGTGGGGCCGTAGATGACCCCGATGACCGGCTGCAGGTGGTAGTTGAGGGAGAGACAGCTGCCGTCCTCGCG
GAGGAGGGGGCCACCTCGTTCATCATCTCGCGCACATGCATGTTCTCGCGCACGAGTTCCGCCAGGAGGCGCTCGCCCCCCA
GCGAGAGGAGCTCTTGCAGCGAGGCGAAGTTTTTCAGCGGCTTGAGYCCGTCGGCCATGGGCATTTTGGAGAGGGTCTGTTG
CAAGAGTTCCAGACGGTCCCAGAGCTCGGTGATGTGCTCTAGGGCATCTCGATCCAGCAGACCTCCTCGTTTCGCGGGTTGGG
GCGACTGCGGGAGTAGGGCACCAGGCGATGGGCGTCCAGCGAGGCCAGGGTCCGGTCCTTCCAGGGTCGCAGGGTCCGCGT
CAGCCGTGGTCTCCGTCACGGTGAAGGGGTGCGCGCCGGGCTGGGCGCTTGCGAGGGTGCGCTTCAGGCTCATCCGGCTGGTC
GAGAACCGCTCCCGGTCGGCGCCCTGCGCGTCGGCCAGGTAGCAATTGAGCATGAGTTCGTAGTTGAGCGCCTCGGCCGCGT
GGCCCTTGGCGCGGAGCTTACCTTTGGAAGTGTGTCCGCAGACGGGACAGAGGAGGGACTTGAGGGCGTAGAGCTTGGGGG
CGAGGAAGACGGACTCGGGGGCGTAGGCGTCCGCGCCGCAGCTGGCGCAGACGGTCTCGCACTCCACGAGCCAGGTGAGGT
CGGGCCGGTTGGGGTCAAAAACGAGGTTTCCTCCGTGCTTTTTGATGCGTTTCTTACCTCTGGTCTCCATGAGCTCGTGTCCCC
GCTGGGTGACAAAGAGGCTGTCCGTGTCCCGTAGACCGACTTTATGGGCCGGTCCTCGAGCGGGGTGCCGCGGTCCTCGTC
GTAGAGGAACCCGCCCACTCCGAGACGAAGGCCCGGGTCCAGGCCAGCACGAAGGAGGCCACGTGGGAGGGGTAGCGGT
CGTTGTCCACCAGCGGGTCCACCTTCTCCAGGGTATGCAAGCACATGTCCCCCTCGTCCACATCCAGGAAGGTGATTGGCTTGT
AAGTGTAGGCCACGTGACCGGGGGTCCGGCCGGGGGGTATAAAAGGGGCGGGCCCCTGCTCGTCCTCACTGTCTTCCG
GATCGCTGTCCAGGAGCGCCAGCTGTTGGGGTAGGTATTCCCTCTCGAAGGCTGGCATAACCTCGGCACTCAGGTTGTCAGTT
TCTAGAAACGAGGAGGATTTGATATTGACGGTGCCGTTGGAGACGCCTTTCATGAGCCCTCGTCCATCTGGTCAGAAAAGAC
GATCTTTTTGTTGTCGAGCTTGGTGGCGAAGGAGCCGTAGAGGGCGTTGGAGAGGAGCTTGGCGATGGAGCGCATGGTCTG
GTTCTTTTCCTTGTCGGCGCGCTCCTTGGCGGCGATGTTGAGCTGCACGTACTCGCGCGCCACGCACTTCCATTCGGGGAAGAC
GGTGGTGAGCTCGTCGGGCACGATTCTGACCCGCCAGCCGCGGTTGTCAGGGTGATGAGGTCCACGCTGGTGGCCACCTCG
CCGCGCAGGGGCTCGTTGGTCCAGCAGAGGCGCCCGCCCTTGCGCGAGCAGAAGGGGGGCAGCGGGTCAGCATGAGCTCG
TCGGGGGGTCGGCGTCCACGGTGAAGATGCCGGGCAGAAGCTCGGGGTCGAAGTAGCTGATGCAGGTGTCCAGATCGTCC
AGCGCCGCTTGCCAGTCGCGCACGGCCAGCGCGCGCTCGTAGGGGCTGAGGGGCGTGCCCAGGGCATGGGGTGCGTGAGC
GCGGAGGCGTACATGCCGCAGATGTCGTAGACGTAGAGGGGCTCCTCGAGGACGCCGATGTAGGTGGGGTAGCAGCGCCCC
CCGCGGATGCTGGCGCGCACGTAGTCGTACAGCTCGTGCGAGGGCGCGAGGAGCCCCGTGCCGAGGTTGGAGCGTTGCGGC
TTTTCGGCGCGGTAGACGATCTGGCGGAAGATGGCGTGGGAGTTGGAGGAGATGGTGGGCCTCTGGAAGATGTTGAAGTGG
GCGTGGGGCAGGCCGACCGAGTCCCTGATGAAGTGGGCGTAGGAGTCCTGCAGCTTGGCGACGAGCTCGGCGGTGACGAGG
ACGTCCAGGGCGCAGTAGTCGAGGGTCTCTTGGATGATGTCGTACTTGAGCTGGCCCTTCTGCTTCCACAGCTCGCGGTTGAG
```

Fig. 26C

```
AAGGAACTCTTCGCGGTCCTTCCAGTACTCTTCGAGGGGGAACCCGTCCTGATCGGCACGGTAAGAGCCCACCATGTAGAACT
GGTTGACGGCCTTGTAGGCGCAGCAGCCCTTCTCCACGGGGAGGGCGTAAGCTTGTGCGGCCTTGCGCAGGGAGGTGTGGG
TGAGGGCGAAGGTGTCGCGCACCATGACCTTGAGGAACTGGTGCTTGAAGTCGAGGTCGTCGCAGCCGCCCTGCTCCCAGAG
CTGGAAGTCCGTGCGCTTCTTGTAGGCGGGGTTGGGCAAAGCGAAAGTAACATCGTTGAAGAGGATCTTGCCCGCGCGGGGC
ATGAAGTTGCGAGTGATGCGGAAAGGCTGGGGCACCTCGGCCCGGTTGTTGATGACCTGGGCGGCGAGGACGATCTCGTCG
AAGCCGTTGATGTTGTGCCCGACGATGTAGAGTTCCACGAATCGCGGGCGGCCCTTAACGTGGGGCAGCTTCTTGAGCTCGTC
GTAGGTGAGCTCGGCGGGGTCGCTGAGCCCGTGCTGCTCGAGGGCCCAGTCGGCGACGTGGGGGTTGGCGCTGAGGAAGG
AAGTCCAGAGATCCACGGCCAGGGCGGTCTGCAAGCGGTCCCGGTACTGACGGAACTGCTGGCCCACGGCCATTTTTTCGGG
GGTGACGCAGTAGAAGGTGCGGGGGTCGCCGTGCCAGCGGTCCCACTTGAGCTGGAGGGCGAGGTCGTGGGCGAGCTCGAC
GAGCGGCGGGTCCCCGGAGAGTTTCATGACCAGCATGAAGGGGACGAGCTGCTTGCCGAAGGACCCCATCCAGGTGTAGGTT
TCCACATCGTAGGTGAGGAAGAGCCTTTCGGTGCGAGGATGCGAGCCGATGGGGAAGAACTGGATCTCCTGCCACCAGTTGG
AGGAATGGCTGTTGATGTGATGGAAGTAGAAATGCCGACGGCGCGCCGAGCACTCGTGCTTGTGTTTATACAAGCGTCCGCA
GTGCTCGCAACGCTGCACGGGATGCACGTGCTGCACGAGCTGTACCTGGGTTCCTTTGACGAGGAATTTCAGTGGGCAGTGG
AGCGCTGGCGGCTGCATCTGGTGCTGTACTACGTCCTGGCCATCGGCGTGGCCATCGTCTGCCTCGATGGTGGTCATGCTGAC
GAGCCCGCGCGGGAGGCAGGTCCAGACTTCGGCTCGGACGGGTCGGAGAGCGAGGACGAGGGCGCGCAGGCCGGAGCTGT
CCAGGGTCCTGAGACGCTGCGGAGTCAGGTCAGTGGGCAGCGGCGGCGCGCGGTTGACTTGCAGGAGCTTTTCCAGGGCGC
GCGGGAGGTCCAGATGGTACTTGATCTCCACGGCGCCGTTGGTGGCGACGTCCACGGCTTGCAGGGTCCCGTGCCCCTGGGG
CGCCACCACCGTGCCCCGTTTCTTCTTGGGCGCTGCTTCCATGCCGGTCAGAAGCGGCGGCGAGGACGCGCGCCGGGCGGCA
GGGGCGGCTCGGGACCCGGAGGCAGGGCGGCAGGGGCACGTCGGCGCCGCGCGCGGGCAGGTTCTGGTACTGCGCCCGG
AGAAGACTGGCGTGAGCGACGACGCGACGGTTGACGTCCTGGATCTGACGCCTCTGGGTGAAGGCCACGGGACCCGTGAGT
TTGAACCTGAAAGAGAGTTCGACAGAATCAATCTCGGTATCGTTGACGGCGGCCTGCCGCAGGATCTCTTGCACGTCGCCCGA
GTTGTCCTGGTAGGCGATCTCGGTCATGAACTGCTCGATCTCCTCCTCCTGAAGGTCTCCGCGGCCGGCGCGCTCGACGGTGG
CCGCGAGGTCGTTGGAGATGCGGCCCATGAGCTGCGAGAAGGCGTTCATGCCGGCCTCGTTCCAGACGCGGCTGTAGACCAC
GGCTCCGTCGGGTCGCGCGCGCGCATGACCACCTGGGCGAGGTTGAGCTCGACGTGGCGCGTGAAGACCGCGTAGTTGCA
GAGGCGCTGGTAGAGGTAGTTGAGCGTGGTGGCGATGTGCTCGGTGACGAAGAAGTACATGATCCAGCGGCGGAGCGGCAT
CTCGCTGACGTCGCCCAGGGCTTCCAAGCGCTCCATGGCCTCGTAGAAGTCCACGGCGAAGTTGAAAAACTGGGAGTTGCGC
GCCGAGACGGTCAACTCCTCCTCCAGAAGACGGATGAGCTCAGCGATGGTGGCGCGCACCTCGCGCTCGAAGGCCCCGGGGG
GCTCCTCTTCTTCCATCTCTTCCTCCTCCACTAACATCTCTTCTACTTCCTCCTCAGGAGGCGGCGGCGGGGAGGGGCCCTGCG
TCGCCGGCGGCGCACGGGCAGACGGTCGATGAAGCGCTCGATGGTCTCCCCGCGCCGGCGACGCATGGTCTCGGTGACGGC
GCGCCCGTCCTCGCGGGGCCGCAGCGTGAAGACGCCGCCGCGCATCTCCAGGTGGCCGCCGGGGGGTCTCCGTTGGGCAG
GGAGAGGGCGCTGACGATGCATCTTATCAATTGGCCCGTAGGGACTCCGCGCAAGGACCTGAGCGTCTCGAGATCCACGGGA
TCCGAAAACCGCTGAACGAAGGCTTCGAGCCAGTCGCAGTCGCAAGGTAGGCTGAGCCCGGTTTCTTGTTCTTCGGGGATTTC
GGGAGGCGGGCGGGCGATGCTGCTGGTGATGAAGTTGAAGTAGGCGGTCCTGAGACGGCGGATGGTGGCGAGGAGCACCA
GGTCCTTGGGCCCGGCTTGCTGGATGCGCAGACGGTCGGCCATGCCCCAGGCGTGGTCCTGACACCTGGCGAGGTCCTTGTA
GTAGTCCTGCATGAGCCGCTCCACGGGCACCTCCTCCTCGCCCGCGCGGCCGTGCATGCGCGTGAGCCCGAACCCGCGCTGGG
GCTGGACGAGCGCCAGGTCGGCGACGACGCGCTCGGCGAGGATGGCCTGCTGTATCTGGGTGAGGGTGGTCTGGAAGTCGT
CGAAGTCGACGAAGCGGTGGTAGGCTCCGGTGTTGATGGTATAGGAGCAGTTGGCCATGACGGACCAGTTGACGGTCTGGT
GGCCGGGTCGCACGAGCTCGTGGTACTTGAGGCGCGAGTAGGCGCGCGTGTCGAAGATGTAGTCGTTGCAGGTGCGCACGA
GGTACTGGTATCCGACGAGGAAGTGCGGCGGCGGCTGGCGGTAGAGCGGCCATCGCTCGGTGGCGGGGCGCCGGGCGCG
AGGTCCTCGAGCATGAGGCGGTGGTAGCCGTAGATGTACCTGGACATCCAGGTGATGCCGGCGGCGGTGGTGGAGGCGCGC
GGGAACTCGCGGACGCGGTTCCAGATGTTGCGCAGCGGCAGGAAGTAGTTCATGGTGGCCGCGGTCTGGCCCGTGAGGCGC
GCGCAGTCGTGGATGCTCTAGACATACGGGCAAAAACGAAAGCGGTCAGCGGCTCGACTCCGTGGCCTGGAGGCTAAGCGA
ACGGGTTGGGCTGCGCGTGTACCCCGGTTCGAATCTCGAATCAGGCTGGAGCCGCAGCTAACGTGGTACTGGCACTCCCGTCT
CGACCCAAGCCTGCTAACGAAACCTCCAGGATACGGAGGCGGGTCGTTTTTGGCCTTGGTCGCTGGTCATGAAAAACTAGTA
AGCGCGGAAAGCGACCGCCCGCGATGGCTCGCTGCCGTAGTCTGGAGAAAGAATCGCCAGGGTTGCGTTGCGGTGTGCCCCG
GTTCGAGCCTCAGCGCTCGGCGCCGGCCGGATTCCGCGGCTAACGTGGGCGTGGCTGCCCCGTCGTTTCCAAGACCCCTTAGC
CAGCCGACTTCTCCAGTTACGGAGCGAGCCCCTCTTTTTCTTGTGTTTTTGCCAGATGCATCCCGTACTGCGGCAGATGCGCCCC
CACCCTCCACCTCAACCGCCCCTACCGCCGCAGCAGCAGCAACAGCCGGCGCTTCTGCCCCCGCCCCAGCAGCAGCCAGCCACT
ACCGCGGCGGCCGCCGTGAGCGGAGCCGGCGTTCAGTATGACCTGGCCTTGGAAGAGGGCGAGGGGCTGGCGCGGCTGGG
GGCGTCGTCGCCGGAGCGGCACCCGCGCGTGCAGATGAAAAGGGACGCTCGCGAGGCCTACGTGCCCAAGCAGAACCTGTT
CAGAGACAGGAGCGGCGAGGAGCCCGAGGAGATGCGCGCCTCCCGCTTCCACGCGGGGCGGGAGCTGCGGCGCGGCCTGG
```

Fig. 26D

ACCGAAAGCGGGTGCTGAGGGACGAGGATTTCGAGGCGGACGAGCTGACGGGGATCAGCCCCGCGCGCGCACGTGGCC
GCGGCCAACCTGGTCACGGCGTACGAGCAGACCGTGAAGGAGGAGAGCAACTTCCAAAAATCCTTCAACAACCACGTGCGCA
CGCTGATCGCGCGCGAGGAGGTGACCCTGGGCCTGATGCACCTGTGGGACCTGCTGGAGGCCATCGTGCAGAACCCCACGAG
CAAGCCGCTGACGGCGCAGCTGTTTCTGGTGGTGCAGCACAGTCGGGACAACGAGACGTTCAGGGAGGCGCTGCTGAATATC
ACCGAGCCCGAGGGCCGCTGGCTCCTGGACCTGGTGAACATTCTGCAGAGCATCGTGGTGCAGGAGCGCGGGCTGCCGCTGT
CCGAGAAGCTGGCGGCTATCAACTTCTCGGTGCTGAGCCTGGGCAAGTACTACGCTAGGAAGATCTACAAGACCCCGTACGTG
CCCATAGACAAGGAGGTGAAGATCGACGGGTTTTACATGCGCATGACCCTGAAAGTGCTGACCCTGAGCGACGATCTGGGGG
TGTACCGCAACGACAGGATGCACCGCGCGGTGAGCGCCAGCCGCCGGCGCGAGCTGAGCGACCAGGAGCTGATGCACAGCC
TGCAGCGGGCCCTGACCGGGGCCGGGACCGAGGGGGAGAGCTACTTTGACATGGGCGCGGACCTGCGCTGGCAGCCCAGCC
GCCGGGCCTTGGAAGCTGCCGGCGGTTCCCCCTACGTGGAGGAGGTGGACGATGAGGAGGAGGAGGGCGAGTACCTGGAA
GACTGATGGCGCGACCGTATTTTTGCTAGATGCAGCAACAGCCACCGCCTCCTGATCCCGCGATGCGGGCGGCGCTGCAGAGC
CAGCCGTCCGGCATTAACTCCTCGGACGATTGGACCCAGGCCATGCAACGCATCATGGCGCTGACGACCCGCAATCCCGAAGC
CTTTAGACAGCAGCCTCAGGCCAACCGGCTCTCGGCCATCCTGGAGGCCGTGGTGCCCTCGCGCTCGAACCCCACGCACGAGA
AGGTGCTGGCCATCGTGAACGCGCTGGTGGAGAACAAGGCCATCCGCGGCGACGAGGCCGGGCTGGTGTACAACGCGCTGC
TGGAGCGCGTGGCCCGCTACAACAGCACCAACGTGCAGACGAACCTGGACCGCATGGTGACCGACGTGCGCGAGGCGGTGT
CGCAGCGCGAGCGGTTCCACCGCGAGTCGAACCTGGGCTCCATGGTGGCGCTGAACGCCTTCCTGAGCACGCAGCCCGCCAA
CGTGCCCCGGGGCCAGGAGGACTACACCAACTTCATCAGCGCGCTGCGGCTGATGGTGGCCGAGGTGCCCCAGAGCGAGGT
GTACCAGTCGGGGCCGGACTACTTCTTCCAGACCAGTCGCCAGGGCTTGCAGACCGTGAACCTGAGCCAGGCTTTCAAGAACT
TGCAGGGACTGTGGGGCGTGCAGGCCCCGGTCGGGGACCGCGCGACGGTGTCGAGCCTGCTGACGCCGAACTCGCGCCTGC
TGCTGCTGCTGGTGGCGCCCTTCACGGACAGCGGCAGCGTGAGCCGCGACTCGTACCTGGGCTACCTGCTTAACCTGTACCGC
GAGGCCATCGGGCAGGCGCACGTGGACGAGCAGACCTACCAGGAGATCACCCACGTGAGCCGCGCGCTGGGCCAGGAGGAC
CCGGGCAACCTGGAGGCCACCCTGAACTTCCTGCTGACCAACCGGTCGCAGAAGATCCCGCCCCAGTACGCGCTGAGCACCGA
GGAGGAGCGCATCCTGCGCTACGTGCAGCAGAGCGTGGGGCTGTTCCTGATGCAGGAGGGGGCCACGCCCAGCGCCGCGCT
CGACATGACCGCGCGCAACATGGAGCCCAGCATGTACGCTCGCAACCGCCCGTTCATCAATAAGCTGATGGACTACTTGCATC
GGGCGGCCGCCATGAACTCGGACTACTTTACCAACGCCATCTTGAACCCGCACTGGCTCCCGCCGCCCGGGTTCTACACGGGC
GAGTACGACATGCCCGACCCCAACGACGGGTTCCTGTGGGACGACGTGGACAGCAGCGTGTTCTCGCCGCGCCCCGCCACCA
CCGTGTGGAAGAAAGAGGGCGGGGACCGGCGGCCGTCCTCGGCGCTGTCCGGTCGCGCGGGTGCTGCCGCGGCGGTGCCTG
AGGCCGCCAGCCCCTTCCCGAGCCTGCCCTTTTCGCTGAACAGCGTGCGCAGCAGCGAGCTGGGTCGGCTGACGCGGCCGCG
CCTGCTGGGCGAGGAGGAGTACCTGAACGACTCCTTGTTGAGGCCCGAGCGCGAGAAGAACTTCCCCAATAACGGGATAGAG
AGCCTGGTGGACAAGATGAGCCGCTGGAAGACGTACGCGCACGAGCACAGGGACGAGCCCCGAGCTAGCAGCAGCGCAGGC
ACCCGTAGACGCCAGCGACACGACAGGCAGCGGGGTCTGGTGTGGGACGATGAGGATTCCGCCGACGACAGCAGCGTGTTG
GACTTGGGTGGGAGTGGTGGTGGTAACCCGTTCGCTCACTTGCGCCCCCGTATCGGGCGCCTGATGTAAGAATCTGAAAAAAT
AAAAAACGGTACTCACCAAGGCCATGGCGACCAGCGTGCGTTCTTCTCTGTTGTTTGTAGTAGTATGATGAGGCGCGTGTACC
CGGAGGGTCCTCCTCCCTCGTACGAGAGCGTGATGCAGCAGGCGGTGGCGGCGGCGATGCAGCCCCGCTGGAGGCGCCTTA
CGTGCCCCGCGGTACCTGGCGCCTACGGAGGGGCGGAACAGCATTCGTTACTCGGAGCTGGCACCCTTGTACGATACCACCC
GGTTGTACCTGGTGGACAACAAGTCGGCGGACATCGCCTCGCTGAACTACCAGAACGACCACAGCAACTTCCTGACCACCGTG
GTGCAGAACAACGATTTCACCCCCACGGAGGCCAGCACCCAGACCATCAACTTTGACGAGCGCTCGCGGTGGGGCGGCCAGC
TGAAAACCATCATGCACACCAACATGCCCAACGTGAACGAGTTCATGTACAGCAACAAGTTCAAGGCGCGGGTGATGGTCTCG
CGCAAGACCCCCAATGGGGTCGCGGTGGATGAGAATTATGATGGTAGTCAGGACGAGCTGACTTACGAGTGGGTGGAGTTTG
AGCTGCCCGAGGGCAACTTCTCGGTGACCATGACCATCGATCTGATGAACAACGCCATCATCGACAACTACTTGGCGGTGGGG
CGTCAGAACGGGGTGCTGGAGAGCGACATCGGCGTGAAGTTCGACACGCGCAACTTCCGGCTGGGCTGGGACCCCGTGACC
GAGCTGGTGATGCCGGGCGTGTACACCAACGAGGCCTTCCACCCCGACATCGTCCTGCTGCCCGGCTGCGGCGTGGACTTCAC
CGAGAGCCGCCTCAGCAACCTGCTGGGCATCCGCAAGCGGCAGCCCTTCCAGGAGGGCTTCCAGATCCTGTACGAGGACCTG
GAGGGGGGCAACATCCCCGCGCTCTTGGATGTCGAAGCCTATGAGAAAAGCAAGGAGGAGGCCGCCGCAGCGGCGACCGCA
GCCGTGGCCACCGCCTCTACCGAGGTGCGGGGCGATAATTTTGCTAGCGCCGCGGCAGTGGCCGAGGCGGCTGAAACCGAAA
GTAAGATAGTCATCCAGCCGGTGGAGAAGGACAGCAAGGACAGGAGCTACAACGTGCTCGCGGACAAGAAAAACACCGCCT
ACCGCAGCTGGTACCTGGCCTACAACTACGGCGACCCCGAGAAGGGCGTGCGCTCCTGGACGCTGCTCACCACCTCGGACGTC
ACCTGCGGCGTGGAGCAAGTCTACTGGTCGCTGCCCGACATGATGCAAGACCCGGTCACCTTCCGCTCCACGCGTCAAGTTAG
CAACTACCCGGTGGTGGGCGCCGAGCTCCTGCCCGTCTACTCCAAGAGCTTCTTCAACGAGCAGGCCGTCTACTCGCAGCAGC
TGCGCGCCTTCACCTCGCTCACGCACGTCTTCAACCGCTTCCCCGAGAACCAGATCCTCGTCCGCCCGCCCGCCCCACCATTAC
CACCGTCAGTGAAAACGTTCCTGCTCTCACAGATCACGGGACCCTGCCGCTGCGCAGCAGTATCCGGGGAGTCCAGCGCGTGA

Fig. 26E

```
CCGTCACTGACGCCAGACGCCGCACCTGCCCCTACGTCTACAAGGCCCTGGGCGTAGTCGCGCCGCGCGTCCTCTCGAGCCGC
ACCTTCTAAAAAATGTCCATTCTCATCTCGCCCAGTAATAACACCGGTTGGGGCCTGCGCGCGCCCAGCAAGATGTACGGAGG
CGCTCGCCAACGCTCCACGCAACACCCCGTGCGCGTGCGCGGGCACTTCCGCGCTCCCTGGGGCGCCCTCAAGGGCCGCGTGC
GCTCGCGCACCACCGTCGACGACGTGATCGACCAGGTGGTGGCCGACGCGCGCAACTACACGCCCGCCGCCGCGCCCGCCTC
CACCGTGGACGCCGTCATCGACAGCGTGGTGGCCGATGCGCGCCGGTACGCCCGCGCCAAGAGCCGGCGGCGGCGCATCGC
CCGGCGGCACCGGAGCACCCCCGCCATGCGCGCGGCGCGAGCCTTGCTGCGCAGGGCCAGGCGCACGGGACGCAGGGCCAT
GCTCAGGGCGGCCAGACGCGCGGCCTCCGGCAGCAGCAGCGCCGGCAGGACCCGCAGACGCGCGGCCACGGCGGCGGCGG
CGGCCATCGCCAGCATGTCCGCCCGCGGCGCGGCAACGTGTACTGGGTGCGCGACGCCGCCACCGGTGTGCGCGTGCCCGT
GCGCACCCGCCCCCCTCGCACTTGAAGATGCTGACTTCGCGATGTTGATGTGTCCCAGCGGCGAGGAGGATGTCCAAGCGCAA
ATACAAGGAAGAGATGCTCCAGGTCATCGCGCCTGAGATCTACGGCCCCGCGGTGAAGGAGGAAAGAAAGCCCCGCAAACT
GAAGCGGGTCAAAAAGGACAAAAAGGAGGAGGAAGATGTGGACGGACTGGTGGAGTTTGTGCGCGAGTTCGCCCCCCGGC
GGCGCGTGCAGTGGCGCGGGCGGAAAGTGAAACCGGTGCTGCGGCCCGGCACCACGGTGGTCTTCACGCCCGGCGAGCGTT
CCGGCTCCGCCTCCAAGCGCTCCTACGACGAGGTGTACGGGGACGAGGACATCCTCGAGCAGGCGGTCGAGCGTCTGGGCGA
GTTTGCTTACGGCAAGCGCAGCCGCCCCGCGCCCTTGAAAGAGGAGGCGGTGTCCATCCCGCTGGACCACGGCAACCCCACG
CCGAGCCTGAAGCCGGTGACCCTGCAGCAGGTGCTGCCGAGCGCGGCGCCGCGCCGGGGCTTCAAGCGCGAGGGCGGCGAG
GATCTGTACCCGACCATGCAGCTGATGGTGCCCAAGCGCCAGAAGCTGGAGGACGTGCTGGAGCACATGAAGGTGGACCCCG
AGGTGCAGCCCGAGGTCAAGGTGCGGCCCATCAAGCAGGTGGCCCCGGGCCTGGGCGTGCAGACCGTGGACATCAAGATCC
CCACGGAGCCCATGGAAACGCAGACCGAGCCGTGAAGCCCAGCACCAGCACCATGGAGGTGCAGACGGATCCCTGGATGCC
GGCGCCGGCTTCCACCACTCGCCGAAGACGCAAGTACGGCGCGGCCAGCCTGCTGATGCCCAACTACGCGCTGCATCCTTCCA
TCATCCCCACGCCGGGCTACCGCGGCACGCGCTTCTACCGCGGCTACACCAGCAGCCGCCGCAAGACCACCACCCGCCGCCGC
CGTCGTCGCACCCGCCGCAGCAGCACCGCGACTTCCGCCGCCGCCCTGGTGCGGAGAGTGTACCGCAGCGGGCGCGAGCCTC
TGACCCTGCCGCGCGCGCGCTACCACCCGAGCATCGCCATTTAACTCTGCCGTCGCCTCCTACTTGCAGATATGGCCCTCACAT
GCCGCCTCCGCGTCCCCATTACGGGCTACCGAGGAAGAAAGCCGCGCCGTAGAAGGCTGACGGGGAACGGGCTGCGTCGCC
ATCACCACCGGCGGCGGCGCGCCATCAGCAAGCGGTTGGGGGGAGGCTTCCTGCCCGCGCTGATCCCCATCATCGCCGCGGC
GATCGGGGCGATCCCCGGCATAGCTTCCGTGGCGGTGCAGGCCTCTCAGCGCCACTGAGACACAGCTTGGAAAATTTGTAATA
AAAAAATGGACTGACGCTCCTGGTCCTGTGATGTGTGTTTTTAGATGGAAGACATCAATTTTTCGTCCCTGGCACCGCGACACG
GCACGCGGCCGTTTATGGGCACCTGGAGCGACATCGGCAACAGCCAACTGAACGGGGCGCCTTCAATTGGAGCAGTCTCTG
GAGCGGGCTTAAGAATTTCGGGTCCACGCTCAAAACCTATGGCAACAAGGCGTGGAACAGCAGCACAGGGCAGGCGCTGAG
GGAAAAGCTGAAAGAGCAGAACTTCCAGCAGAAGGTGGTCGATGGCCTGGCCTCGGGCATCAACGGGGTGGTGGACCTGGC
CAACCAGGCCGTGCAGAAACAGATCAACAGCCGCCTGGACGCGGTCCCGCCCGCGGGGTCCGTGGAGATGCCCCAGGTGGA
GGAGGAGCTGCCTCCCCTGGACAAGCGCGGCGACAAGCGACCGCGTCCCGACGCGGAGGAGACGCTGCTGACGCACACGGA
CGAGCCGCCCCCGTACGAGGAGGCGGTGAAACTGGGTCTGCCCACCACGCGGCCCGTGGCGCCTCTGGCCACCGGGGTGCTG
AAACCCAGCAGCAGCAGCCAGCCCGCGACCCTGGACTTGCCTCCGCCTGCTTCCCGCCCCTCCACAGTGGCTAAGCCCCTGCCG
CCGGTGGCCGTCGCGTCGCGCGCCCCCGAGGCCGCCCCAGGCGAACTGGCAGAGCACTCTGAACAGCATCGTGGGTCTGG
GAGTGCAGAGTGTGAAGCGCCGCCGCTGCTATTAAAAGACACTGTAGCGCTTAACTTGCTTGTCTGTGTATATGTATGTCC
GCCGACCAGAAGGAGGAAGAGGCGCGTCGCCGAGTTGCAAGATGGCCACCCCATCGATGCTGCCCCAGTGGGCGTACATGC
ACATCGCCGGACAGGACGCTTCGGAGTACCTGAGTCCGGGTCTGGTGCAGTTCGCCCGCGCCACAGACACCTACTTCAGTCTG
GGGAACAAGTTTAGGAACCCCACGGTGGCGCCCACGCACGATGTGACCACCGACCGCAGCCAGCGGCTGACGCTGCGCTTCG
TGCCCGTGGACCGCGAGGACAACACCTACTCGTACAAAGTGCGCTACACGCTGGCCGTGGGCGACAACCGCGTGCTGGACAT
GGCCAGCACCTACTTTGACATCCGCGGCGTGCTGGATCGGGGCCCAGCTTCAAACCCTACTCCGGCACCGCCTACAACAGCC
TGGCTCCCAAGGGAGCGCCCAACACTTGCCAGTGGACATATAAAGCTGGTGATACTGATACAGAAAAAACCTATACATATGGA
AATGCACCTGTGCAAGGCATTAGCATTACAAAGGATGGTATTCAACTTGGAACTGACAGCGATGGTCAGGCAATCTATGCAGA
CGAAACTTATCAACCAGAGCCTCAAGTGGGTGATGCTGAATGGCATGACATCACTGGTACTGATGAAAAATATGGAGGCAGA
GCTCTTAAGCCTGACACCAAATGAAGCCTTGCTATGGTTCTTTTGCCAAGCCTACCAATAAAGAAGGAGGCCAGGCAAATGT
GAAAACCGAAACAGGCGGTACCAAAGAATATGACATTGACATGGCATTCTTCGATAATCGAAGTGCAGCTGCCGCCGGCCTA
GCCCCAGAAATTGTTTTGTATACTGAGAATGTGGATCTGGAAACTCCAGATACCCATATTGTATACAAGGCAGGTACAGATGA
CAGTAGCTCTTCTATCAATTTGGGTCAGCAGTCCATGCCCAACAGACCCAACTACATTGGCTTCAGAGACAACTTTATCGGTCT
GATGTACTACAACAGCACTGGCAATATGGGTGTACTGGCTGGACAGGCCTCCCAGCTGAATGCTGTGGTGGACTTGCAGGAC
AGAAACACCGAACTGTCCTACCAGCTCTTGCTTGACTCTCTGGGTGACAGAACCAGGTATTTCAGTATGTGGAATCAGGCGGT
GGACAGTTATGACCCCGATGTGCGCATTATTGAAAATCACGGTGTGGAGGATGAACTTCCTAACTATTGCTTCCCCCTGGATGC
TGTGGGTAGAACTGATACTTACCAGGGAATTAAGGCCAATGGTGATAATCAAACCACCTGGACCAAAGATGATACTGTTAATG
```

Fig. 26F

```
ATGCTAATGAATTGGGCAAGGGCAATCCTTTCGCCATGGAGATCAACATCCAGGCCAACCTGTGGCGGAACTTCCTCTACGCG
AACGTGGCGCTGTACCTGCCCGACTCCTACAAGTACACGCCGGCCAACATCACGCTGCCCACCAACACCAACACCTACGATTAC
ATGAACGGCCGCGTGGTGGCGCCCTCGCTGGTGGACGCCTACATCAACATCGGGGCGCGCTGGTCGCTGGACCCCATGGACA
ACGTCAACCCCTTCAACCACCACCGCAACGCGGGCCTGCGATACCGCTCCATGCTCCTGGGCAACGGGCGCTACGTGCCCTTCC
ACATCCAGGTGCCCCAAAAGTTTTTCGCCATCAAGAGCCTCCTGCTCCTGCCCGGGTCCTACACCTACGAGTGGAACTTCCGCA
AGGACGTCAACATGATCCTGCAGAGCTCCCTCGGCAACGACCTGCGCACGGACGGGGCCTCCATCGCCTTCACCAGCATCAAC
CTCTACGCCACCTTCTTCCCCATGGCGCACAACACCGCCTCCACGCTCGAGGCCATGCTGCGCAACGACACCAACGACCAGTCC
TTCAACGACTACCTCTCGGCGGCCAACATGCTCTACCCCATCCCGGCCAACGCCACCAACGTGCCCATCTCCATCCCCTCGCGCA
ACTGGGCCGCCTTCCGCGGCTGGTCCTTCACGCGCCTCAAGACCCGCGAGACGCCCTCGCTCGGCTCCGGGTTCGACCCCTACT
TCGTCTACTCGGGCTCCATCCCCTACCTCGACGGCACCTTCTACCTCAACCACACCTTCAAGAAGGTCTCCATCACCTTCGACTCC
TCCGTCAGCTGGCCCGGCAACGACCGCCTCCTGACGCCCAACGAGTTCGAAATCAAGCGCACCGTCGACGGAGAGGGGTACA
ACGTGGCCCAGTGCAACATGACCAAGGACTGGTTCCTGGTCCAGATGCTGGCCCACTACAACATCGGCTACCAGGGCTTCTAC
GTGCCCGAGGGCTACAAGGACCGCATGTACTCCTTCTTCCGCAACTTCCAGCCCATGAGCCGCCAGGTCGTGGACGAGGTCAA
CTACAAGGACTACCAGGCCGTCACCCTGGCCTACCAGCACAACAACTCGGGCTTCGTCGGCTACCTCGCGCCCACCATGCGCC
AGGGCCAGCCCTACCCCGCCAACTACCCCTACCCGCTCATCGGCAAGAGCGCCGTCGCCAGCGTCACCCAGAAAAAGTTCCTC
TGCGACCGGGTCATGTGGCGCATCCCCTTCTCCAGCAACTTCATGTCCATGGGCGCGCTCACCGACCTCGGCCAGAACATGCTC
TACGCCAACTCCGCCCACGCGCTAGACATGAATTTCGAAGTCGACCCCATGGATGAGTCCACCCTTCTCTATGTTGTCTTCGAA
GTCTTCGACGTCGTCCGAGTGCACCAGCCCCACCGCGGCGTCATCGAGGCCGTCTACCTGCGCACGCCCTTCTCGGCCGGCAA
CGCCACCACCTAAGCCTCTTGCTTCTTGCAAGATGACGGCCTGCGCGGGCTCCGGCGAGCAGGAGCTCAGGGCCATCCTCCGC
GACCTGGGCTGCGGGCCCTGCTTCCTGGGCACCTTCGACAAGCGCTTCCCGGGATTCATGGCCCCGCACAAGCTGGCCTGCGC
CATCGTCAACACGGCCGGCCGCGAGACCGGGGGCGAGCACTGGCTGGCCTTCGCCTGGAACCCGCGCTCCCACACCTGCTAC
CTCTTCGACCCCTTCGGGTTCTCGGACGAGCGCCTCAAGCAGATCTACCAGTTCGAGTACGAGGGCCTGCTGCGTCGCAGCGC
CCTGGCCACCGAGGACCGCTGCGTCACCCTGGAAAAGTCCACCCAGACCGTGCAGGGTCCGCGCTCGGCCGCCTGCGGGCTC
TTCTGCTGCATGTTCCTGCACGCCTTCGTGCACTGGCCCGACCGCCCCATGGACAAGAACCCCACCATGAACTTGCTGACGGGG
GTGCCCAACGGCATGCTCCAGTCGCCCCAGGTGGAACCCACCCTGCGCCGCAACCAGGAGGCGCTCTACCGCTTCCTCAACGC
CCACTCCGCCTACTTTCGCTCCCACCGCGCGCGCATCGAGAAGGCCACCGCCTTCGACCGCATGAATCAAGACATGTAATCCGG
TGTGTGTATGTGAATGCTTTATTCATCATAATAAACAGCACATGTTTATGCCACCTTCTCTGAGGCTCTGACTTTATTTAGAAATC
GAAGGGGTTCTGCCGGCTCTCGGCATGGCCCGCGGGCAGGGATACGTTGCGGAACTGGTACTTGGGCAGCCACTTGAACTCG
GGGATCAGCAGCTTCGGCACGGGGAGGTCGGGGAACGAGTCGCTCCACAGCTTGCGCGTGAGTTGCAGGGCGCCCAGCAGG
TCGGGCGCGGAGATCTTGAAATCGCAGTTGGGACCCGCGTTCTGCGCGCGAGAGTTACGGTACACGGGGTTGCAGCACTGGA
ACACCATCAGGGCCGGGTGCTTCACGCTCGCCAGCACCGTCGCGTCGGTGATGCCCTCCACGTCCAGATCCTCGGCGTTGGCC
ATCCCGAAGGGGGTCATCTTGCAGGTCTGCCGCCCCATGCTGGGCACGCAGCCGGGCTTGTGGTTGCAATCGCAGTGCAGGG
GGATCAGCATCATCTGGGCCTGCTCGGAGCTCATGCCCGGGTACATGGCCTTCATGAAAGCCTCCAGCTGGCGGAAGGCCTGC
TGCGCCTTGCCGCCCTCGGTGAAGAAGACCCCGCAGGACTTGCTAGAGAACTGGTTGGTGGCGCAGCCAGCGTCGTGCACGC
AGCAGCGCGCGTCGTTGTTGGCCAGCTGCACCACGCTGCGCCCCAGCGGTTCTGGGTGATCTTGGCCCGGTCGGGGTTCTCC
TTCAGCGCGCGCTGCCCGTTCTCGCTCGCCACATCCATCTCGATCGTGTGCTCCTTCTGGATCATCACGGTCCCGTGCAGGCACC
GCAGCTTGCCCTCGGCCTCGGTGCACCCGTGCAGCCACAGCGCGCAGCCGGTGCTCTCCCAGTTCTTGTGGGCGATCTGGGAG
TGCGAGTGCACGAAGCCCTGCAGGAAGCGGCCCATCATCGTGGTCAGGGTCTTGTTGCTGGTGAAGGTCAGCGGAATGCCGC
GGTGCTCCTCGTTCACATACAGGTGGCAGATACGGCGGTACACCTCGCCCTGCTCGGGCATCAGCTGGAAGGCGGACTTCAG
GTCGCTCTCCACGCGGTACCGGTCCATCAGCAGCGTCATCACTTCCATGCCCTTCTCCCAGGCCGAAACGATCGGCAGGCTCAG
GGGGTTCTTCACCGTTGTCATCTTAGTCGCCGCCGCCGAAGTCAGGGGGTCGTTCTCGTCCAGGGTCTCAAACACTCGCTTGCC
GTCCTTCTCGGTGATGCGCACGGGGGAAAGCTGAAGCCCACGGCCGCCAGCTCCTCCTCGGCCTGCCTTTCGTCCTCGCTGT
CCTGGCTGATGTCTTGCAAAGGCACATGCTTGGTCTTGCGGGGTTTCTTTTTGGGCGGCAGAGGCGGCGGCGGAGACGTGCT
GGGCGAGCGCGAGTTCTCGCTCACCACGACTATTTCTTCTCCTTGGCCGTCGTCCGAGACCACGCGGCGGTAGGCATGCCTCTT
CTGGGGCAGAGGCGGAGGCGACGGGCTCTCGCGGTTCGGCGGGCGGCTGGCAGAGCCCTTCCGCGTTCGGGGGTGCGCTC
CTGGCGGCGCTGCTCTGACTGACTTCCTCCGCGGCCGGCCATTGTGTTCTCCTAGGGAGCAAGCATGGAGACTCAGCCATCGT
CGCCAACATCGCCATCTGCCCCCGCCGCCGCCGACGAGAACCAGCAGCAGCAGAATGAAAGCTTAACCGCCCCGCCGCCCAGC
CCCACCTCCGACGCCGCAGCCCAGACATGCAAGAGATGGAGGAATCCATCGAGATTGACCTGGGCTACGTGACGCCCGCGG
AGCACGAGGAGGAGCTGGCAGCGCGCTTTTCAGCCCCGGAAGAGAACCACCAAGAGCAGCCAGAGCAGGAAGCAGAGAGC
GAGCAGAACCAGGCTGGGCTCGAGCATGGCGACTACCTGAGCGGGGCAGAGGACGTGCTCATCAAGCATCTGGCCCGCCAA
TGCATCATCGTCAAGGACGCGCTGCTCGACCGCGCCGAGGTGCCCCTCAGCGTGGCGGAGCTCAGCCGCGCCTACGAGCGCA
```

Fig. 26G

```
ACCTCTTCTCGCCGCGCGTGCCCCCCAAGCGCCAGCCCAACGGCACCTGCGAGCCCAACCCGCGCCTCAACTTCTACCCGGTCT
TCGCGGTGCCCGAGGCCCTGGCCACCTACCACCTCTTTTTCAAGAACCAAAGGATCCCCGTCTCCTGCCGCGCCAACCGCACCC
GCGCCGACGCCCTGCTCAACCTGGGCCCCGGCGCCCGCCTACCTGATATCGCCTCCTTGGAAGAGGTTCCCAAGATCTTCGAG
GGTCTGGGCAGCGACGAGACTCGGGCCGCGAACGCTCTGCAAGGAAGCGGAGAGGAGCATGAGCACCACAGCGCCCTGGTG
GAGTTGGAAGGCGACAACGCGCGCCTGGCGGTCCTCAAGCGCACGGTCGAGCTGACCCACTTCGCCTACCCGGCGCTCAACC
TGCCCCCAAGGTCATGAGCGCCGTCATGGACCAGGTGCTCATCAAGCGCGCCTCGCCCCTCTCGGAGGAGGAGATGCAGGA
CCCCGAGAGCTCGGACGAGGGCAAGCCCGTGGTCAGCGACGAGCAGCTGGCGCGCTGGCTGGGAGCGAGTAGCACCCCCCA
GAGCCTGGAAGAGCGGCGCAAGCTCATGATGGCCGTGGTCCTGGTGACCGTGGAGCTGGAGTGTCTGCGCCGCTTCTTCGCC
GACGCGGAGACCCTGCGCAAGGTCGAGGAGAACCTGCACTACCTCTTCAGACACGGGTTCGTGCGCCAGGCCTGCAAGATCT
CCAACGTGGAGCTGACCAACCTGGTCTCCTACATGGGCATCCTGCACGAGAACCGCCTGGGGCAGAACGTGCTGCACACCACC
CTGCGCGGGGAGGCCCGCCGCGACTACATCCGCGACTGCGTCTACCTGTACCTCTGCCACACCTGGCAGACGGGCATGGGCG
TGTGGCAGCAGTGCCTGGAGGAGCAGAACCTGAAAGAGCTCTGCAAGCTCCTGCAGAAGAACCTCAAGGCCCTGTGGACCGG
GTTCGACGAGCGCACCACCGCCGCGGACCTGGCCGACCTCATCTTCCCCGAGCGCCTGCGGCTGACGCTGCGCAACGGGCTGC
CCGACTTTATGAGCCAAAGCATGTTGCAAAACTTTCGCTCTTTCATCCTCGAACGCTCCGGGATCCTGCCCGCCACCTGCTCCGC
GCTGCCCTCGGACTTCGTGCCGCTGACCTTCCGCGAGTGCCCCCGCCGCTCTGGAGCCACTGCTACCTGCTGCGCCTGGCCAA
CTACCTGGCCTACCACTCGGACGTGATCGAGGACGTCAGCGGCGAGGGCCTGCTCGAGTGCCACTGCCGCTGCAACCTCTGCA
CGCCGCACCGCTCCCTGGCCTGCAACCCCAGCTGCTGAGCGAGACCCAGATCATCGGCACCTTCGAGTTGCAAGGCCCCGGC
GAGGGCAAGGGGGGTCTGAAACTCACCCCGGGGCTGTGGACCTCGGCCTACTTGCGCAAGTTCGTGCCCGAGGACTACCATC
CCTTCGAGATCAGGTTCTACGAGGACCAATCCCAGCCGCCCAAGGCCGAGCTGTCGGCCTGCGTCATCACCCAGGGGGCCATC
CTGGCCCAATTGCAAGCCATCCAGAAATCCCGCCAAGAATTTCTGCTGAAAAAGGGCCACGGGGTCTACTTGGACCCCAGAC
CGGAGAGGAGCTCAACCCCAGCTTCCCCCAGGATGCCCCGAGGAAGCAGCAAGAAGCTGAAAGTGGAGCTGCCGCCGCCGC
CGGAGGATTTGGAGGAAGACTGGGAGAGCAGTCAGGCAGAGGAGGAGGAGATGGAAGACTGGGACAGCACTCAGGCAGA
GGAGGACAGCCTGCAAGACAGTCTGGAGGAGGAAGACGAGGTGGAGGAGGCAGAGGAAGAAGCAGCCGCCGCCAGACCG
TCGTCCTCGGCGGAGGAGGAGAAAGCAAGCAGCACGGATACCATCTCCGCTCCGGGTCGGGGTCGCGGCGGCCGGGCCCAC
AGTAGATGGGACGAGACCGGGCGCTTCCCGAACCCCACCACCCAGACCGGTAAGAAGGAGCGGCAGGGATACAAGTCCTGG
CGGGGGCACAAAAACGCCATCGTCTCCTGCTTGCAAGCCTGCGGGGGCAACATCTCCTTCACCCGGCGCTACCTGCTCTTCCAC
CGCGGGGTGAACTTCCCCCGCAACATCTTGCATTACTACCGTCACCTCCACAGCCCCTACTACTGTTTCCAAGAAGAGGCAGAA
ACCCAGCAGCAGCAGCAGCAGCAGAAAACCAGCGGCAGCAGCTAGAAAATCCACAGCGGCGGCAGGTGGACTGAGGATCGC
GGCGAACGAGCCGGCGCAGACCCGGGAGCTGAGGAACCGGATCTTTCCCACCCTCTATGCCATCTTCCAGCAGAGTCGGGGG
CAAGAGCAGGAACTGAAAGTCAAGAACCGTTCTCTGCGCTCGCTCACCCGCAGTTGTCTGTATCACAAGAGCGAAGACCAACT
TCAGCGCACTCTCGAGGACGCCGAGGCTCTCTTCAACAAGTACTGCGCGCTCACTCTTAAAGAGTAGCCCGCGCCCGCCCACA
CACGGAAAAAGGCGGGAATTACGTCACCACCTGCGCCCTTCGCCCGACCATCATCATGAGCAAAGAGATTCCCACGCCTTACA
TGTGGAGCTACCAGCCCCAGATGGGCCTGGCCGCCGGCGCCGCCCAGGACTACTCCACCCGCATGAACTGGCTCAGTGCCGG
GCCCGCGATGATCTCACGGGTGAATGACATCCGCGCCCACCGAAACCAGATACTCCTAGAACAGTCAGCGATCACCGCCACGC
CCCGCCATCACCTTAATCCGCGTAATTGGCCCGCCGCCCTGGTGTACCAGGAAATTCCCAGCCCACGACCGTACTACTTCCGC
GAGACGCCCAGGCCGAAGTCCAGCTGACTAACTCAGGTGTCCAGCTGGCCGGCGGCGCCGCCCTGTGTCGTCACCGCCCCGCT
CAGGGTATAAAGCGGCTGGTGATCCGAGGCAGAGGCACACAGCTCAACGACGAGGTGGTGAGCTCTTCGCTGGGTCTGCGA
CCTGACGGAGTCTTCCAACTCGCCGGATCGGGGAGATCTTCCTTCACGCCTCGTCAGGCCGTCCTGACTTTGGAGAGTTCGTCC
TCGCAGCCCCGCTCGGGTGGCATCGGCACTCTCCAGTTCGTGGAGGAGTTCACTCCCTCGGTCTACTTCAACCCCTTCTCCGGC
TCCCCCGGCCACTACCCGGACGAGTTCATCCCGAACTTCGACGCCATCAGCGAGTCGGTGGACGGCTACGATTGAATGTCCCA
TGGTGGCGCGGCTGACCTAGCTCGGCTTCGACACCTGGACCACTGCCGCCGCTTCCGCTGCTTCGCTCGGGATCTCGCCGAGT
TTGCCTACTTTGAGCTGCCCGAGGAGCACCCTCAGGGCCCGGCCCACGGAGTGCGGATCGTCGTCGAAGGGGGTCTCGACTC
CCACCTGCTTCGGATCTTCAGCCAGCGTCCGATCCTGGCCGAGCGCGAGCAAGGACAGACCCTTCTGACCCTGTACTGCATCTG
CAACCACCCCGGCCTGCATGAAAGTCTTTGTTGTCTGCTGTGTACTGAGTATAATAAAAGCTGAGATCAGCGACTACTCCGGAC
TTCCGTGTGTTCCTGCTATCAACCAGTCCCTGTTCTTCACCGGGAACGAGACCGAGCTCCAGCTCCAGTGTAAGCCCCACAAGA
AGTACCTCACCTGGCTGTTCCAGGGCTCTCCGATCGCCGTTGTCAACCACTGCGACAACGACGGAGTCCTGCTGAGCGGCCCT
GCCAACCTTACTTTTTCCACCCGCAGAAGCAAGCTCCAGCTCTTCCAACCCTTCCTCCCCGGGACCTATCAGTGCGTCTCGGGAC
CCTGCCATCACACCTTCCACCTGATCCCGAATACCACAGCGTCGCTCCCCGCTACTAACAACCAAACTACCCACCAACGCCACCG
TCGCGACCGCGGACATGTACAGAGCTCGAGAAGTACTAGGCCACAATACATGCCCATATTAGACTATGAGGCCGAGCCACAG
CGACCCATGCTCCCCGCTATTAGTTACTTCAATCTAACCGGCGGAGATGACTGACCCACTGGCCAACAACAACGTCAACGACCT
TCTCCTGGACATGGACGGCCGCGCCTCGGAGCAGCGACTCGCCCAACTTCGCATTCGCCAGCAGCAGGAGAGAGCCGTCAAG
```

Fig. 26H

```
GAGCTGCAGGACGGCATAGCCATCCACCAGTGCAAGAAAGGCATCTTCTGCCTGGTGAAACAGGCCAAGATCTCCTACGAGG
TCACCCCGACCGACCATCGCCTCTCCTACGAGCTCCTGCAGCAGCGCCAGAAGTTCACCTGCCTGGTCGGAGTCAACCCCATCG
TCATCACCCAGCAGTCGGGCGATACCAAGGGGTGCATCCACTGCTCCTGCGACTCCCCGACTGCGTCCACACTCTGATCAAGA
CCCTCTGCGGCCTCCGCGACCTCCTCCCCATGAACTAATCACCCCCTTATCCAGTGAAATAAATATCATATTGATGATGATTTAA
ATAAAAAATAATCATTTGATTTGAAATAAAGATACAATCATATTGATGATTTGAGTTTTAAAAAATAAAGAATCACTTACTTGAA
ATCTGATACCAGGTCTCTGTCCATGTTTTCTGCCAACACCACCTCACTCCCCTCTTCCCAGCTCTGGTACTGCAGACCCCGGCGG
GCTGCAAACTTCCTCCACACGCTGAAGGGGATGTCAAATTCCTCCTGTCCCTCAATCTTCATTTTATCTTCTATCAGATGTCCAAA
AAGCGCGTCCGGGTGGATGATGACTTCGACCCCGTCTACCCCTACGATGCAGACAACGCACCGACCGTGCCCTTCATCAACCC
CCCCTTCGTCTCTTCAGATGGATTCCAAGAGAAGCCCCTGGGGGTGCTGTCCCTGCGACTGGCTGACCCCGTCACCACCAAGAA
CGGGGAAATCACCCTCAAGCTGGGAGAGGGGGTGGACCTCGACTCCTCGGGAAAACTCATCTCCAACACGGCCACCAAGGCC
GCCGCCCCTCTCAGTTTTTCCAACAACACCATTTCCCTTAACATGGATACCCCTCTTTATACCAAAGATGGAAAATTATCCTTACA
AGTTTCTCCACCGTTAAACATATTAAAATCAACCATTCTGAACACATTAGCTGTAGCTTATGGATCAGGTTTAGGACTGAGTGG
TGGCACTGCTCTTGCAGTACAGTTGGCCTCTCCACTCACTTTTGATGAAAAAGGGAAATATTAAAATTAACCTAGCCAGTGGTCC
ATTAACAGTTGATGCAAGTCGACTTAGTATCAACTGCAAAAGAGGGGTCACTGTCACTACCTCAGGAGATGCAATTGAAAGCA
ACATAAGCTGGCCTAAAGGTATAAGATTTGAAGGTAATGGCATAGCTGCAAACATTGGCAGAGGATTGGAATTTGGAACCAC
TAGTACAGAGACTGATGTCACAGATGCATACCCAATTCAAGTTAAATTGGGTACTGGCCTTACCTTTGACAGTACAGGCGCCAT
TGTTGCTTGGAACAAAGAGGATGATAAACTTACATTATGGACCACAGCCGACCCCTCGCCAAATTGCAAAATATACTCTGAAAA
AGATGCCAAACTCACACTTTGCTTGACAAAGTGTGGAAGTCAAATTCTGGGTACTGTGACTGTATTGGCAGTGAATAATGGAA
GTCTCAACCCAATCACAAACACAGTAAGCACTGCACTCGTCTCCCTCAAGTTTGATGCAAGTGGAGTTTTGCTAAGCAGCTCCA
CATTAGACAAAGAATATTGGAACTTCAGAAAGGGAGATGTTACACCTGCTGAGCCCTATACTAATGCTATAGGTTTTATGCCTA
ACATAAAGGCCTATCCTAAAAACACATCTGCAGCTTCAAAAAGCCATATTGTCAGTCAAGTTTATCTCAATGGGGATGAGGCCA
AACCACTGATGCTGATTATTACTTTTAATGAAACTGAGGATGCAACTTGCACCTACAGTATCACTTTTCAATGGAAATGGGATA
GTACTAAGTACACAGGTGAAACACTTGCTACCAGCTCCTTCACCTTCTCCTACATCGCCCAAGAATGAACACTGTATCCCACCCT
GCATGCCAACCCTTCCCACCCCACTCTGTCTATGGAAAAAACTCTGAAGCACAAAATAAAATAAAGTTCAAGTGTTTTATTGATT
CAACAGTTTTACAGGATTCGAGCAGTTATTTTCCTCCACCCTCCCAGGACATGGAATACACCACCCTCTCCCCCCGCACAGCCT
TGAACATCTGAATGCCATTGGTGATGGACATGCTTTTGGTCTCCACGTTCCACACAGTTTCAGAGCGAGCCAGTCTCGGGTCGG
TCAGGGAGATGAAACCCTCCGGGCACTCCCGCATCTGCACCTCACAGCTCAACAGCTGAGGATTGTCCTCGGTGGTCGGGATC
ACGGTTATCTGGAAGAAGCAGAAGAGCGGCGGTGGGAATCATAGTCCGCGAACGGGATCGGCCGGTGGTGTCGCATCAGGC
CCCGCAGCAGTCGCTGCCGCCGCCGCTCCGTCAAGCTGCTGCTCAGGGGGTCCGGGTCCAGGGACTCCCTCAGCATGATGCCC
ACGGCCCTCAGCATCAGTCGTCTGGTGCGGCGGGCGCAGCAGCGCATGCGGATCTCGCTCAGGTCGCTGCAGTACGTGCAAC
ACAGGACCACCAGGTTGTTCAACAGTCCATAGTTCAACACGCTCCAGCCGAAACTCATCGCGGGAAGGATGCTACCCACGTGG
CCGTCGTACCAGATCCTCAGGTAAATCAAGTGGCGCTCCCTCCAGAACACGCTGCCCACGTACATGATCTCCTTGGGCATGTGG
CGGTTCACCACCTCCCGGTACCACATCACCCTCTGGTTGAACATGCAGCCCGGATGATCCTGCGGAACCACAGGGCCAGCAC
CGCCCCGCCCGCCATGCAGCGAAGAGACCCCGGGTCCCGGCAATGGCAATGGAGGACCCACCGCTCGTACCCGTGGATCATC
TGGGAGCTGAACAAGTCTATGTTGGCACAGCACAGGCATATGCTCATGCATCTCTTCAGCACTCTCAGCTCCTCGGGGGTCAA
AACCATATCCCAGGGCACGGGGAACTCTTGCAGGACAGCGAACCCCGCAGAACAGGGCAATCCTCGCACATAACTTACATTGT
GCATGGACAGGGTATCGCAATCAGGCAGCACCGGGTGATCCTCCACCAGAGAAGGCGCGGGTCTCGGTCTCCTCACAGCGTGG
TAAGGGGGCCGGCCGATACGGGTGATGGCGGACGCGGCTGATCGTGTTCGCGACCGTGTCATGATGCAGTTGCTTTCGGAC
ATTTTCGTACTTGCTGTAGCAGAACCTGGTCCGGGCGCTGCACACCGATCGCCGGCGGCGGTCCCGGCGCTTGGAACGCTCGG
TGTTGAAATTGTAAAACAGCCACTCTCTCAGACCGTGCAGCAGATCTAGGGCCTCAGGAGTGATGAAGATCCCATCATGCCTG
ATAGCTCTGATCACATCGACCACCGTGGAATGGGCCAGACCCAGCCAGATGATGCAATTTGTTGGGTTTCGGTGACGGCGGG
GGAGGGAAGAACAGGAAGAACCATGATTAACTTTTAATCCAAACGGTCTCGGAGCACTTCAAAATGAAGGTCGCGGAGATGG
CACCTCTCGCCCCGCTGTGTTGGTGGAAAATAACAGCCAGGTCAAAGGTGATACGGTTCTCGAGATGTTCCACGGTGGCTTC
CAGCAAAGCCTCCACGCGCACATCCAGAAACAAGACAATAGCGAAAGCGGGAGGGTTCTCTAATTCCTCAATCATCATGTTAC
ACTCCTGCACCATCCCCAGATAATTTTCATTTTTCCAGCCTTGAATGATTCGAACTAGTTCCTGAGGTAAATCCAAGCCAGCCAT
GATAAAGAGCTCGCGCAGAGCGCCCTCCACCGGCATTCTTAAGCACACCCTCATAATTCCAAGATATTCTGCTCCTGGTTCACC
TGCAGCAGATTGACAAGCGGAATATCAAAATCTCTGCCGCGATCCCTAAGCTCCTCCCTCAGCAATAACTGTAAGTACTCTTTC
ATATCCTCTCCGAAATTTTTAGCCATAGGACCACCAGGAATAAGATTAGGGCAAGCCACAGTACAGATAAACCGAAGTCCTCCC
CAGTGAGCATTGCCAAATGCAAGACTGCTATAAGCATGCTGGCTAGACCCGGTGATATCTTCCAGATAACTGGACAGAAAATC
ACCCAGGCAATTTTTAAGAAAATCAACAAAAGAAAAATCCTCCAGGTGCACGTTTAGAGCCTCGGGAACAACGATGAAGTAAA
TGCAAGCGGTGCGTTCCAGCATGGTTAGTTAGCTGATCTGTAAAAAACAAAAAATAAAACATTAAACCATGCTAGCCTGGCGA
ACAGGTGGGTAAATCGTTCTCTCCAGCACCAGGCAGGCCACGGGGTCTCCGGCGCGACCCTCGTAAAAATTGTCGCTATGATT
GAAAACCATCACAGAGAGACGTTCCCGGTGGCCGGCGTGAATGATTCGACAAGATGAATACACCCCCGGAACATTGGCGTCC
GCGAGTGAAAAAAGCGCCCGAGGAAGCAATAAGGCACTACAATGCTCAGTCTCAAGTCCAGCAAAGCGATGCCATGCGGAT
GAAGCACAAAATCCTCAGGTGCGTACAAAATGTAATTACTCCCCTCCTGCACAGGCAGCGAAGCCCCGATCCCTCCAGATACA
CATACAAAGCCTCAGCGTCCATAGCTTACCGAGCAGCAGCACACAACAGGCGCAAGAGTCAGAGAAAGGCTGAGCTCTAACC
TGTCCACCCGCTCTCTGCTCAATATATAGCCCAGATCTACACTGACGTAAAGGCCAAAGTCTAAAAATACCCGCCAAATAATCA
CACACGCCCAGCACACGCCCAGAAACCGGTGACACACTCAAAAAAATACGCGCACTTCCTCAAACGCCCAAACTGCCGTCATTT
CCGGGTTCCCACGCTACGTCATCGGAATTCGACTTTCAAATTCCGTCGACCGTTAAAAACGTCACCCGCCCCGCCCCTAACGGT
CGCCCGTCTCTCGGCCAATCACCTTCCTCCCTCCCCAAATTCAAACAGCTCATTTGCATATTAACGCGCACCAAAAGTTTGAGGT
ATATTATTGATGATG
```

Fig. 26I

AdC7 010-DU172gp160(E1622) Amino acids – SEQ ID NO: 15
The symbol " * " refers herein to stop codons in the non coding regions HHQ*YTSNFWCALICK*AV*IWGGRKVIGRETGDR*GRGG*RFDDVAVRRSRFASSRGKSDVKRGVV*TRKYSIFPRSLTGNEVFLG
GCK*KRAIFARKLNEEVKI*VISRLWQGGVFAEGRVDFDRLRGGFDYRIFHLNFRVRCQSPVFLRTISFPRKCHLTVTITVLR*RKLRSP
DPLWCTLSTICSDAA*LSQYLLPACVLEVAE*CASKI*ATTRQGLTDNCMKNLLRVRRFALLRDVRARYTR*H*LLTSMPSTPPIDVND
GKWPAWHYAQYMTLWDFPTWQYIYVLVIAITMVMRFWQYINGRG*RFDSRGFPSLHPIDVNGSLFWHQNQRDFPKCRNNSAP
LTQMGGRRVRWEVYISRARLVNRQITRSFIAVVYHS*IANAVSASDTTVSNLRLEYLIRLTIG*LRLEFDATMRVMGILRSYQQWWI
WGILGFWMLMICNVWGNLWVTVYYGVPVWKEAKTTLFCASDAKAHKEEVHNIWATHACVPTDPNPQEIVLKNVTENFNMWK
NDMVDQMHEDIISLWDQSLKPCVKLTPLCVTLNCSDVKIKGTNATYNNATYNNNNTISDMKNCSFNTTTEITDKKKKEYALFYKLDV
VALDGKETNSTNSSEYRLINCNTSAVTQACPKVSFDPIPIHYCAPAGYAILKCNNKTFNGTGPCNNVSTVQCTHGIKPVVSTQLLLNG
SLAEEEVVIRFENLTNNAKIIVHLNESVEINCTRPSNNTRKSVRIGPGQTFFATGDIIGDIRQAHCNISRKKWNTTLQRVKEKLKEKFPN
KTIQFAPSSGGDLEITTHSFNCRGEFFYCYTSDLFNSTYMSNNTGGANITLQCRIKQIIRMWQGVGQAMYAPPIAGNITCKSNITGLL
LTRDGGKEKNDTETFRPGGGDMRDNWRSELYKYKVVEIKPLGIAPDKAKRRVVEREKRAVGIGAVFLGFLGAAGSTMGAASMTLT
VQARQLLSGIVQQQSNLLRAIEAQQHMLQLTVWGIKQLQTRVLAIERYLKDQQLLGIWGCSGKLICTTAVPWNASWSNKSYEEIW
GNMTWMQWDREINNYTNTIYSLLEESQNQQEKNEKDLLALDSWESLWSWFNITNWLWYIRIFIIVGGLIGLRIIFAVLSIVNRVRQ
GYSPLSFQTLTPSPREPDRLGRIEEEGGEQDRARSVRLVNGFLALAWEDLRSLCLFSYHRLRDLILIAARAAALLGRSSLWGLQKGWE
ALKYLGSLVQYWGLELKKSAISLFDAIAITVAEGTDRIINIVQRISRAFYNIPRRIRQGFEATLQ*GTSRVDPGGQTADQPRLCLLVASHL
LFAPPPCLP*PWKVPLPLSFPNKMRKLHRIV*VGVILFWGVGWGRTARGRIGKTIAGMLGMRWALWLLRRKEPADLQI*IHLCRVR
RKRNGIMGIMGLHIGQISICWPPCM*PRTPARHGPSSSTTS*PDAMCTWGPAEACSCPTSATCNL*RCCWSPMPCPE*A*R
GCLT*MWSCGKF*DMMNPRPGAGPANAEASTPGFSPCVWR*RRTCDPIIWCCPATGRSSAPAGKNLTRVSSVWGRWRACMRG
RMTKICVFLCVAAA*AEAPPLREGYSALI*RGVSPPGRECVRM*WDPRWTAGPCSPRTLQP*PTRP*APRPWTQLPPQLLLPPPAP
CAEWPWAPATTALWWPTRLPPIIPPA*TRRSCCC*WPSSRP*PSAWAS*PSRWLSCRRRRGPRLPR*KPNKK*INK*TETVVDFNT
ES*IFI*FFARGRPWTTGLDH*APGGFFPGPGRGGLGC*GTWA*ARPGGGGSSIAGPRARGWCCKSPSHSRGAGRGAARCP*GG
D*WPRAAPWCRC*RTC*AGRDACGGR*DASWPGS*DWRCSRPDPAGGSCCAGPPARCIRRTWGICHATWKGRRERIWRRPCD
RPGFPCTHP**WRWARGRRPGQRRFGGRTHRSCGPG*ARHRPF**IWGGGCPTGGRRCPRSRGRSCPRRSASPRP*ARRGGSCP
PAGR*KKRFPGRGR*AGPKAGSGAAGTCRSRWGRR*PR*PAAGGS*GRDSCRPRGGGGPPRSSSRAHACSRARVPPGGARPPAR
GALAARRSFSAA*XRRPWAFWRGSVARVPDGPRAR*CALGHLDPADLLVSRVGATAGVGHQAMGVQRGQGPVLPGSQGPRQR
GLRHGEGVRAGLGACEGALQAHPAGREPLPVGALRVGQVAIEHEFVVERLGRVALGAELTFGSVSADGTEEGLEGVELGGEEDGLG
GVGVRAAAGADGLALHEPGEVGPVGVKNEVSSVLFDAFLTSGLHELVSPLGDKEAVRVPVDRLYGPVLERGAAVLVVEEPRPLRDE
GPGPGQHEGGHVGGVAVVVHQRVHLLQGMQAHVPLVHIQEGDWLVSVGHVTGGPGRGGIKGGGPLLVLTVFRIAVQERQLLG*
VFPLEGWHNLGTQVVSF*KRGGFDIDGAVGDAFHEPLVHLVRKDDLFVVELGGEGAVEGVGEELGDGAHGLVLFLVGALLGGDVE
LHVLARHALPFGEDGGELVGHDSDPPAAVVQGDEVHAGGHLAAQGLVGPAEAPALARAEGGQRVQHELVGGVGVHGEDAGQK
LGVEVADAGVQIVQRRLPVAHGQRALVGAEGRAPGHGVRERGGVHAADVVDVEGLLEDADVGGVAAPPADAGAHVVVQLVRG
REEPRAEVGALRLFGAVDDLAEDGVGVGGDGGPLEDVEVGVGQADRVPDEVGVGVLQLGDELGGDEDVQGAVVEGLLDDVVLE
LALLLPQLAVEKELFAVLPVLFEGEPVLIGTVRAHHVELVDGLVGAAALLHGEGVSLCGLAQGGVGEGEGVAHHDLEELVLEVEVVA
AALLPELEVRALLVGGVGQSESNIVEEDLARAGHEVASDAERLGHLGPVVDDLGGEDDLVEAVDVVPDDVEFHESRAALNVGQLLE
LVVGELGGVAEPVLLEGPVGDVGVGAEEGSPEIHGQGGLQAVPVLTELLAHGHFFGGDAVEGAGVAVPAVPLELEGEVVGELDER
RVPGEFHDQHEGDELLAEGPHPGVGFHIVGEEEPFGARMRADGEELDLLPPVGGMAVDVMEVEMPTARRALVLVFIQASAVLATL
HGMHVLHELYLGSFDEEFQWAVERWRLHLVLYYVLAIGVAIVCLDGGHADEPAREAGPDFGSDGSESEDEGAQAGAVQGPETLRS
QVSGQRRRAVDLQELFQGAREVQMVLDLHGAVGGDVHGLQGPVPLGRHHRAPFLLGRCFHAGQKRRRGRAPGGRGGSGPGGR
GGRGTSAPRAGRFWYCARRRLA*ATTRRLTSWI*RLWVKATGPVSLNLKESSTESISVSLTAACRRISCTSPELSW*AISVMNCSISSS
*RSPRPARSTVAARSLEMRPMSCEKAFMPASFQTRL*TTAPSGSRARMTTWARLSSTWRVKTA*LQRRW*R*LSVVAMCSVTKKY
MIQRRSGISLTSPRASKRSMAS*KSTAKLKNWELRAETVNSSSRRRMSSAMVARTSRSKAPGGSSSSISSSSTNISSTSSSGGGGGGG
ALRRRRTGRRSMKRSMVSPRRRRMVSVTARPSSRGRSVKTPPRISRWPPGGSPLGRERALTMHLINWPVGTPRKDLSVSRSTGSE
NR*TKASSQSQSQGRLSPVSCSSGISGGGRAMLLVMKLK*AVLRRRMVARSTRSLGPACWMRRRSAMPQAWS*HLARSL**SCM
SRSTGTSSSPARPCMRVSPNPRWGWTSARSATTRSARMACCIWVRVVWKSSKSTKRW*APVLMV*EQLAMTDQLTVWWPGRT
SSWYLRRE*ARVSKM*SLQVRTRYWYPTRKCGGGWR*SGHRSVAGAPGARSSSMRRW*P*MYLDIQVMPAAVVEARGNSRTRF
QMLRSGRK*FMVAAVWPVRRAQSWML*TYGQKRKRSAARLRGLEAKRTGWAARVPRFESRIRLEPQLTWYWHSRLDPSLLTKPP
GYGGGSFFGLGRWS*KTSKRGKRPPAMARCRSLEKESPGLRCGVPRFEPQRSAPAGFRG*RGRGCPVVSKTP*PADFSSYGASPSF
SCVFARCIPYCGRCAPTLHLNRPYRRSSSNSRRFCPRPSSSQPLPRRPP*AEPAFSMTWPWKRARGWRGWGRRRRSGTRACR*KG

Fig. 26J

```
TLARPTCPSRTCSETGAARSPRRCAPPASTRGGSCGAAWTESGC*GTRISRRTS*RGSAPRARTWPRPTWSRRTSRP*RRRATSKNP
STTTCAR*SRARR*PWA*CTCGTCWRPSCRTPRASR*RRSCFWWCSTVGTTRRSGRRC*ISPSPRAAGSWTW*TFCRASWCRSAG
CRCPRSWRLSTSRC*AWASTTLGRSTRPRTCP*TRR*RSTGFTCA*P*KC*P*ATIWGCTATTGCTAR*APAAGAS*ATRS*CTACS
GP*PGPGPRGRATLTWARTCAGSPAAGPWKLPAVPPTWRRWTMRRRRASTWKTDGATVFLLDAATATAS*SRDAGGAAEPAV
RH*LLGRLDPGHATHHGADDPQSRSL*TAASGQPALGHPGGRGALALEPHAREGAGHRERAGGEQGHPRRRGRAGVQRAAGAR
GPLQQHQRADEPGPHGDRRARGGVAARAVPPRVEPGLHGGAERLPEHAARQRAPGPGGLHQLHQRAAADGGRGAPERGVPV
GAGLLLPDQSPGLADREPEPGFQELAGTVGRAGPGRGPRDGVEPADAELAPAAAAGGALHGQRQREPRLVPGLPA*PVPRGHRA
GARGRADLPGDHPREPRAGPGGPGQPGGHPELPADQPVAEDPAPVRAEHRGGAHPALRAAERGAVPDAGGGHAQRRARHDR
AQHGAQHVRSQPPVHQ*ADGLLASGGRHELGLLYQRHLEPALAPAARVLHGRVRHARPQRRVPVGRRGQQRVLAAPRHHRVEE
RGRGPAAVLGAVRSRGCCRGGA*GRQPLPEPALFAEQRAQQRAGSADAAAPAGRGGVPERLLVEARAREELPQ*RDREPGGQDE
PLEDVRARAQGRAPS*QQRRHP*TPATRQAAGSGVGR*GFRRRQQRVGLGWEWWW*PVRSLAPPYRAPDVRI*KNKKRYSPRP
WRPACVLLCCL**YDEARVPGGSSSLVRERDAAGGGGGDAAPAGGALRAPAVPGAYGGAEQHSLLGAGTLVRYHPVVPGGQQV
GGHRLAELPERPQQLPDHRGAEQRFHPHGGQHPDHQL*RALAVGRPAENHHAHQHAQRERVHVQQQVQGAGDGLAQDPQW
GRGG*EL*W*SGRADLRVGGV*AARGQLLGDHDHRSDEQRHHRQLLGGGASERGAGERHRREVRHAQLPAGLGPRDRAGDAG
RVHQRGLPPRHRPAARLRRGLHREPPQQPAGHPQAAALPGGLPDPVRGPGGGQHPRALGCRSL*EKQGGGRRSGDRSRGHRLY
RGAGR*FC*RRGSGRGG*NRK*DSHPAGGEGQQGQELQRARGQEKHRLPQLVPGLQLRRPREGRALLDAAHHLGRHLRRGASLL
VAARHDARPGHLPLHASS*QLPGGGRRAPARLLQELLQRAGRLLAAAARLHLAHARLQPLPREPDPRPPARAHHYHRQ*KRSCSHR
SRDPAAAQQYPGSPARDRH*RQTPHLPLRLQGPGRSRAARPLEPHLLKNVHSHLAQ**HRLGPARAQQDVRRRSPTLHATPRARA
RALPRSLGRPQGPRALAHHRRRRDRPGGGRRAQLHARRRARLHRGRRHRQRGGRCAPVRPRQEPAAAHRPAAPEHPRHARGAS
LAAQGQAHGTQGHAQGGQTRGLRQQQRRQDPQTRGHGGGGGHRQHVPPAARQRVLGARRRHRCARARAHPPPSHLKMLTS
RC*CVPAARRMSKRKYKEEMLQVIAPEIYGPAVKEERKPRKLKRVKKDKKEEEDVDGLVEFVREFAPRRRVQWRGRKVKPVLRPGT
TVVFTPGERSGSASKRSYDEVYGDEDILEQAVERLGEFAYGKRSRPAPLKEEAVSIPLDHGNPTPSLKPVTLQQVLPSAAPRRGFKREG
GEDLYPTMQLMVPKRQKLEDVLEHMKVDPEVQPEVKVRPIKQVAPGLGVQTVDIKIPTEPMETQTEPVKPSTSTMEVQTDPWMP
APASTTRRRRKYGAASLLMPNYALHPSIIPTPGYRGTRFYRGYTSSRRKTTTRRRRRRTRRSSTATSAAALVRRVYRSGREPLTLPRARY
HPSIAI*LCRRLLLADMALTCRLRVPITGYRGRKPRRRRLTGNGLRRHHHRRRRAISKRLGGGFLPALIPIIAAAIGAIPGIASVAVQASQ
RH*DTAWKICNKKMD*RSWSCDVCF*MEDINFSSLAPRHGTRPFMGTWSDIGNSQLNGGAFNWSSLWSGLKNFGSTLKTYGNK
AWNSSTGQALREKLKEQNFQQKVVDGLASGINGVVDLANQAVQKQINSRLDAVPPAGSVEMPQVEEELPPLDKRGDKRPRPDAE
ETLLTHTDEPPPYEEAVKLGLPTTRPVAPLATGVLKPSSSSQPATLDLPPPASRPSTVAKPLPPVAVASRAPRGRPQANWQSTLNSIV
GLGVQSVKRRRCY*KTL*RLTCLSVCICMSADQKEEEARRRVARWPPHRCCPSGRTCTSPDRTLRST*VRVWCSSPAPQTPTSVWG
TSLGTPRWRPRTM*PPTAASG*RCASCPWTARTTPTRTKCATRWPWATTACWTWPAPTLTSAACWIGGPASNPTPAPPTTAWL
PRERPTLASGHIKLVILIQKKPIHMEMHLCKALALQRMVFNLELTAMVRQSMQTKLINQSLKWVMLNGMTSLVLMKNMEAELLSL
TPK*SLAMVLLPSLPIKKEARQM*KPKQAVPKNMTLTWHSSIIEVQLPPA*PQKLFCILRMWIWKLQIPILYTRQVQMTVALLSIWVS
SPCPTDPTTLASETTLSV*CTTTALAIWVYWLDRPPS*MLWWTCRTETPNCPTSSCLTLWVTEPGISVCGIRRWTVMTPMCALLKIT
VWRMNFLTIASPWMLWVELILTRELRPMVIIKPPGPKMILLMMLMNWARAILSPWRSTSRPTCGGTSSTRTWRCTCPTPTSTRRP
TSRCPPTPTPTIT*TAAWWRPRWWTPTSTSGRAGRWTPWTTSTPSTTTATRACDTAPCSWATGATCPSTSRCPKSFSPSRASCSCP
GPTPTSGTSARTST*SCRAPSATTCARTGPPSPSPASTSTPPSSPWRTTPPPRSRPCCATTPTTSPSTTTSRRPTCSTPSRPTPPTCPSPS
PRATGPPSAAGPSRASRPARRPRSAPGSTPTSSTRAPSPTSTAPSTSTTPSRRSPSPSTPPSAGPATTAS*RPTSSKSSAPSTERGTTWP
SAT*PRTGSWSRCWPTTTSATRASTCPRATRTACTPSSATSSP*AARSWTRSTTRTTRPSPWPTSTTTRASSATSRPPCARASPTPPT
TPTRSSARAPSPASPRKSSSATGSCGASPSPATSCPWARSPTSARTCSTPTPPTR*T*ISKSTPWMSPPFSMLSSKSSTSSECTSPTAAS
SRPSTCARPSRPATPPPKPLASCKMTACAGSGEQELRAILRDLGCGPCFLGTFDKRFPGFMAPHKLACAIVNTAGRETGGEHWLAFA
WNPRSHTCYLFDPFGFSDERLKQIYQFEYEGLLRRSALATEDRCVTLEKSTQTVQGPRSAACGLFCCMFLHAFVHWPDRPMDKNPT
MNLLTGVPNGMLQSPQVEPTLRRNQEALYRFLNAHSAYFRSHRARIEKATAFDRMNQDM*SGVCM*MLYSS**TAHVYATFSEA
LTLFRNRRGSAGSRHGPRAGIRCGTGTWAAT*TRGSAASARGGRGTSRSTACA*VAGRPAGRARRS*NRSWDPRSARESYGTRGC
STGTPSGPGASRSPAPSRR*CPPRPDPRRWPSRRGSSCRSAAPCWARSRACGCNRSAGGSASSGPARSSCPGTWPS*KPPAGGRP
AAPCRPR*RRPRRTC*RTGWWRSQRRARSSARRCWPAAPRCAPSGSG*SWPGRGSPSARAARSRSPHPSRSCAPSGSSRSRAGT
AACPRPRCTRAATARSRCSPSSCGRSGSASARSPAGSGPSSWSGSCCW*RSAECRGAPRSHTGGRYGGTPRPARASAGRRTSGRSP
RGTGPSAASSLPCPSPRPKRSAGSGGSSPLSS*SPPPKSGGRSRPGSQTLACRPSR*CARGES*SPRPPAPPRPAFRPRCPG*CLAKAH
AWSCGVSFWAAEAAAETCWASASSRSPRLFLLLGRRPRPRGGRHASSGAEAEATGSRGSAGGWQSPFRVRGCAPGGAALTDFLR
GRPLCSPREQAWRLSHRRQHRHLPPPPPTRTSSSRMKA*PPRRPAPPPTPQPQTCKRWRNPSRLTWAT*RPRSTRRSWQRAFQP
RKRTTKSSQSRKQRASRTRLGSSMATT*AGQRTCSSSIWPANASSSRTRCSTAPRCPSAWRSSAAPTSATSSRRACPPSASPTAPASP
TRASTSTRSSRCPRPWPPTTSFSRTKGSPSPAAPTAPAPTPCSTWAPAPAYLISPPWKRFPRSSRVWAATRLGPRTLCKEAERSMSTT
```

Fig. 26K

APWWSWKATTRAWRSSSARSS*PTSPTRRSTCPPRS*APSWTRCSSSAPRPSRRRRCRTPRARTRASPWSATSSWRAGWERVAP
PRAWKSGASS*WPWSW*PWSWSVCAASSPTRRPCARSRRTCTTSSDTGSCARPARSPTWS*PTWSPTWASCTRTAWGRTCCTP
PCAGRPAATTSATASTCTSATPGRRAWACGSSAWRSRT*KSSASSCRRTSRPCGPGSTSAPPPRTWPTSSSPSACG*RCATGCPTL*
AKACCKTFALSSSNAPGSCPPPAPRCPRTSCR*PSASAPRRSGATATCCAWPTTWPTTRT*SRTSAARACSSATAAATSARRTAPWP
ATPSC*ARPRSSAPSSCKAPARARGV*NSPRGCGPRPTCASSCPRTTIPSRSGSTRTNPSRPRPSCRPASSPRGPSWPNCKPSRNPAK
NFC*KRATGSTWTPRPERSSTPASPRMPRGSSKKLKVELPPPPEDLEEDWESSQAEEEEMEDWDSTQAEEDSLQDSLEEEDEVEEA
EEEAAAARPSSSAEEEKASSTDTISAPGRGRGGRAHSRWDETGRFPNPTTQTGKKERQGYKSWRGHKNAIVSCLQACGGNISFTRR
YLLFHRGVNFPRNILHYYRHLHSPYYCFQEEAETQQQQQQQKTSGSS*KIHSGGRWTEDRGERAGADPGAEEPDLSHPLCHLPAES
GARAGTESQEPFSALAHPQLSVSQERRPTSAHSRGRRGSLQQVLRAHS*RVARARPHTEKGGNYVTTCALRPTIIMSKEIPTPYMWS
YQPQMGLAAGAAQDYSTRMNWLSAGPAMISRVNDIRAHRNQILLEQSAITATPRHHLNPRNWPAALVYQEIPQPTTVLLPRDAQ
AEVQLTNSGVQLAGGAALCRHRPAQGIKRLVIRGRGTQLNDEVVSSSLGLRPDGVFQLAGSGRSSFTPRQAVLTLESSSSQPRSGGI
GTLQFVEEFTPSVYFNPFSGSPGHYPDEFIPNFDAISESVDGYD*MSHGGAADLARLRHLDHCRRFRCFARDLAEFAYFELPEEHPQG
PAHGVRIVVEGGLDSHLLRIFSQRPILAEREQGQTLLTLYCICNHPGLHESLCCLLCTEYNKS*DQRLLRTSVCSCYQPVPVLHRERDRA
PAPV*APQEVPHLAVPGLSDRRCQPLRQRRSPAERPCQPYFFHPQKQAPALPTLPPRDLSVRLGTLPSHLPPDPEYHSVAPRY*QPN
YPPTPPSRPRTCTELEKY*ATIHAHIRL*GRATATHAPRY*LLQSNRRR*LTHWPTTTSTTFSWTWTAAPRSSDSPNFAFASSRREPSR
SCRTA*PSTSARKASSAW*NRPRSPTRSPRPTIASPTSSCSSARSSPAWSESTPSSSPSSRAIPRGASTAPATPPTASTL*SRPSAASATS
SP*TNHPLIQ*NKYHIDDDLNKK*SFDLK*RYNHIDDLSFKK*RITYLKSDTRSLSMFSANTTSLPSSQLWYCRPRRAANFLHTLKGMS
NSSCPSIFILSSIRCPKSASGWMMTSTPSTPTMQTTHRPCPSSTPPSSLQMDSKRSPWGCCPCDWLTPSPPRTGKSPSSWERGWTS
TPRENSSPTRPPRPPPLSVFPTTPFPLTWIPLFIPKMENYPYKFLHR*TY*NQPF*TH*L*LMDQV*D*VVALLLQYSWPLHSLLMKKE
ILKLT*PVVH*QLMQVDLVSTAKEGSLSLPQEMQLKAT*AGLKV*DLKVMA*LQTLAEDWNLEPLVQRLMSQMHTQFKLNWVLA
LPLTVQAPLLLGTKRMINLHYGPQPTPRQIAKYTLKKMPNSHFA*QSVEVKFWVL*LYWQ*IMEVSTQSQTQ*ALHSSPSSLMQVE
FC*AAPH*TKNIGTSEREMLHLLSPILML*VLCLT*RPILKTHLQLQKAILSVKFISMGMRPNH*C*LLLLMKLRMQLAPTVSLFNGNG
IVLSTQVKHLLPAPSPSPTSPKNEHCIPPCMPTLPTPLCLWKKL*STK*NKVQVFY*FNSFTGFEQLFFLHPPRTWNTPPSPPAQP*TS
ECHW*WTCFWSPRSTQFQSEPVSGRSGR*NPPGTPASAPHSSTAEDCPRWSGSRLSGRSRRAAVGIIVRERDRPVVSHQAPQQSL
PPPLRQAAAQGVRVQGLPQHDAHGPQHQSSGAAGAAAHADLAQVAAVRATQDHQVVQQSIVQHAPAETHRGKDATHVAVVP
DPQVNQVALPPEHAAHVHDLLGHVAVHHLPVPHHPLVEHAAPDDPAEPQGQHRPARHAAKRPRVPAMAMEDPPLVPVDHLGA
EQVYVGTAQAYAHASLQHSQLLGGQNHIPGHGELLQDSEPRRTGQSSHITYIVHGQGIAIRQHRVILHQRSAGLGLLTAW*GGRPIR
VMAGRG*SCSRPCHDAVAFGHFRTCCSRTWSGRCTPIAGGGPGAWNARC*NCKTATLSDRAADLGPQERSHHAL*SHRPP
WNGPDPAR*CNFVGFR*RRGREEQEEP*LTFNPNGLGALQNEGRGDGTSRPRCVGGK*QPGQR*YGSRDVPRWLPAKPPRAHP
ETRQ*RKREGSLIPQSSCYTPAPSPDNFHFSSLE*FELVPEVNPSQP**RARAERPPPAFLSTPS*FQDILLLVHLQQIDKRNIKISAAIPK
LLPQQ*L*VLFHILSEIFSHRTTRNKIRASHSTDKPKSSPVSIAKCKTAISMLARPGDIFQITGQKITQAIFKKINKRKILQVHV*SLGNND
EVNASGAFQHG*LADL*KTKNKTLNHASLANRWVNRSLQHQAGHGVSGATLVKIVAMIENHHRETFPVAGVNDSTR*IHPRNIGV
RE*KKAPEEAIRHYNAQSQVQQSDAMRMKHKILRCVQNVITPLLHRQRSPRSLQIHIQSLSVHSLPSSSTQQAQESEKG*ALTCPPAL
CSIYSPDLH*RKGQSLKIPAK*SHTPSTRPETGDTLKKIRALPQTPKLPSFPGSHATSSEFDFQIPSTVKNVTRPAPNGRPSLGQSPSSLP
KFKQLICILTRTKSLRYIIDD

Fig. 27A

AdC7 010-DU422gp160(E1623) Nucleic Acids – SEQ ID NO: 8

```
CATCATCAATAATATACCTCAAACTTTTGGTGCGCGTTAATATGCAAATGAGCTGTTTGAATTTGGGGAGGGAGGAAGGTGAT
TGGCCGAGAGACGGGCGACCGTTAGGGGCGGGGCGGGTGACGTTTTGATGACGTGGCCGTGAGGCGGAGCCGGTTTGCAA
GTTCTCGTGGGAAAAGTGACGTCAAACGAGGTGTGGTTTGAACACGGAAATACTCAATTTTCCCGCGCTCTCTGACAGGAAAT
GAGGTGTTTCTGGGCGGATGCAAGTGAAAACGGGCCATTTTCGCGCGAAAACTGAATGAGGAAGTGAAAATCTGAGTAATTT
CGCGTTTATGGCAGGGAGGAGTATTTGCCGAGGGCCGAGTAGACTTTGACCGATTACGTGGGGGTTTCGATTACCGTATTTTT
CACCTAAATTTCCGCGTACGGTGTCAAAGTCCGGTGTTTTTACGTACGATATCATTTCCCCGAAAGTGCCACCTGACCGTAACTA
TAACGGTCCTAAGGTAGCGAAAGCTCAGATCTCCCGATCCCCTATGGTGCACTCTCAGTACAATCTGCTCTGATGCCGCATAGT
TAAGCCAGTATCTGCTCCCTGCTTGTGTGTTGGAGGTCGCTGAGTAGTGCGCGAGCAAAATTTAAGCTACAACAAGGCAAGGC
TTGACCGACAATTGCATGAAGAATCTGCTTAGGGTTAGGCGTTTTGCGCTGCTTCGCGATGTACGGGCCAGATATACGCGTTG
ACATTGATTATTGACTAGTATGCCAAGTACGCCCCTATTGACGTCAATGACGGTAAATGGCCCGCCTGGCATTATGCCCAGTA
CATGACCTTATGGGACTTTCCTACTTGGCAGTACATCTACGTATTAGTCATCGCTATTACCATGGTGATGCGGTTTTGGCAGTAC
ATCAATGGGCGTGGATAGCGGTTTGACTCACGGGGATTTCCAAGTCTCCACCCCATTGACGTCAATGGGAGTTTGTTTTGGCA
CCAAAATCAACGGGACTTTCCAAAATGTCGTAACAACTCCGCCCCATTGACGCAAATGGGCGGTAGGCGTGTACGGTGGGAG
GTCTATATAAGCAGAGCTCGTTTAGTGAACCGTCAGATCACTAGAAGCTTTATTGCGGTAGTTTATCACAGTTAAATTGCTAAC
GCAGTCAGTGCTTCTGACACAACAGTCTCGAACTTAAGGCTAGAGTTCGACGCCACCATGCGCGTGCGCGGCATCCCCCGCAA
CTGGCCCCAGTGGTGGATCTGGGGCATCCTGGGCTTCTGGATGATCATCATCTGCCGCGTGGTGGGCAACCTGGACCTGTGG
GTGACCGTGTACTACGGCGTGCCCGTGTGGAAGGAGGCCAAGACCACCCTGTTCTGCGCCTCCGACGCCAAGGCCTACGACA
AGGAGGTGCACAACGTGTGGGCCACCCACGCCTGCGTGCCCACCGACCCCAACCCCCAGGAGATCGTGCTGGAGAACGTGAC
CGAGAACTTCAACATGTGGAAGAACGACATGGTGGACCAGATGCACGAGGACATCATCTCCCTGTGGGACCAGTCCCTGAAG
CCCTGCGTGAAGCTGACCCCCCTGTGCGTGACCCTGAACTGCAAGAACGTGAACATCTCCGCCAACGCCAACGCCACCGCCAC
CCTGAACTCCTCCATGAACGGCGAGATCAAGAACTGCTCCTTCAACACCACCACCGAGCTGCGCGACAAGAAGCAGAAGGTGT
ACGCCCTGTTCTACAAGCCCGACGTGGTGCCCCTGAACGGCGGCGAGCACAACGAGACCGGCGAGTACATCCTGATCAACTG
CAACTCCTCCACCATCACCCAGGCCTGCCCCAAGGTGTCCTTCGACCCCATCCCCATCCACTACTGCGCCCCCGCCGGCTACGCC
ATCCTGAAGTGCAACAACAAGACCTTCAACGGCACCGGCCCCTGCAACAACGTGTCCACCGTGCAGTGCACCCACGGCATCAA
GCCCGTGGTGTCCACCCAGCTGCTGCTGAACGGCTCCCTGGCCGAGGAGGAGATCATCGTGCGCTCCGAGAACCTGACCAAC
AACATCAAGACCATCATCGTGCACCTGAACAAGTCCGTGGAGATCAAGTGCACCCGCCCCAACAACAACACCCGCAAGTCCGT
GCGCATCGGCCCCGGCCAGACCTTCTACGCCACCGGCGAGATCATCGGCGACATCCGCGAGGCCCACTGCAACATCTCCCGCG
AGACCTGGAACTCCACCCTGATCCAGGTGAAGGAGAAGCTGCGCGAGCACTACAACAAGACCATCAAGTTCGAGCCCTCCTCC
GGCGGCGACCTGGAGGTGACCACCCACTCCTTCAACTGCCGCGGCGAGTTCTTCTACTGCGACACCACCAAGCTGTTCAACGA
GACCAAGCTGTTCAACGAGTCCGAGTACGTGGACAACAAGACCATCATCCTGCCCTGCCGCATCAAGCAGATCATCAACATGT
GGCAGGAGGTGGGCCGCGCCATGTACGCCCCCCCCATCGAGGGCAACATCACCTGCAAGTCCAACATCACCGGCCTGCTGCT
GACCTGGGACGGCGGCGAGAACTCCACCGAGGGCGTGTTCCGCCCCGGCGGCGGCAACATGAAGGACAACTGGCGCTCCGA
GCTGTACAAGTACAAGGTGGTGGAGATCAAGCCCCTGGGCGTGGCCCCCACCAAGAGCAAGCGCAAGGTGGTGGGCCGCGA
GAAGCGCGCCGTGGGCCTGGGCGCCGTGCTGCTGGGCTTCCTGGGCGCCGCCGGCAGCACCATGGGCGCCGCCAGCATCACC
CTGACCGTGCAGGCCCGCCAGCTGCTGAGCGGCATCGTGCAGCAGCAGAGCAACCTGCTGCGCGCCATCGAGGCCCAGCAGC
ACCTGCTGCAGCTGACCGTGTGGGGCATCAAGCAGCTGCAGACCCGCGTGCTGGCCATCGAGCGCTACCTGAAGGACCAGCA
GCTGCTGGGCCTGTGGGGCTGCAGCGGCAAGCTGATCTGCGCCACCGCCGTGCCCTGGAACAGCAGCTGGAGCAACAAGAG
CCTGGGCGACATCTGGGACAACATGACCTGGATGCAGTGGGACCGCGAGATCAGCAACTACACCAACACCATCTTCCGCCTGC
TGGAGGACAGCCAGAACCAGCAGGAGAAGAACGAGAAGGACCTGCTGGCCCTGGACAGCTGGAAGAACCTGTGGAACTGGT
TCGACATCACCAACTGGCTGTGGTACATCAAGATCTTCATCATGATCGTGGGCGGCCTGATCGGCCTGCGCATCATCTTCGGCG
TGCTGGCCATCGTGAAGCGCGTGCGCCAGGGCTACAGCCCCCTGAGCTTCCAGACCCTGATCCCCAACCCCCGCGGCCCCGAC
CGCCTGGGCCGCATCGAGGAGGAGGGCGGCGAGCAGGACAAGGACCGCAGCATCCGCCTGGTGAGCGGCTTCCTGGCCCTG
GCCTGGGACGACCTGCGCAGCCTGTGCCTGTTCAGCTACCACCAGCTGCGCGACTTCATCCTGACCGCCGCCCGCGCCGCCGA
GCTGCTGGGCCGCAGCAGCCTGCGCGGCCTGCAGCGCGGCTGGGAGGTGCTGAAGTACCTGGGCAACCTGGTGCAGTACTG
GGGCCTGGAGCTGAAGCGCAGCGCCATCAACCTGTTCGACACCATCGCCATCGCCGTGGCCGAGGGCACCGACCGCATCATC
GAGGTGATCCAGCGCATCTGCCGCGCCATCCGCTACATCCCCACCCGCATCCGCCAGGGCTTCGAGGCCGCCCTGCTGTAAGG
TACCTCTAGAGTCGACCCGGGCGGCCAAACGCTGATCAGCCTCGACTGTGCCTTCTAGTTGCCAGCCATCTGTTGTTTGCCCC
TCCCCCGTGCCTTCCTTGACCCTGGAAGGTGCCACTCCCACTGTCCTTTCCTAATAAAATGAGGAAATTGCATCGCATTGTCTGA
GTAGGTGTCATTCTATTCTGGGGGGTGGGGTGGGCAGGACAGCAAGGGGGAGGATTGGGAAGACAATAGCAGGCATGCT
```

Fig. 27B

```
GGGGATGCGGTGGGCTCTATGGCTTCTGAGGCGGAAAGAACCAGCAGATCTGCAGATCTGAATTCATCTATGTCGGGTGCGG
AGAAAGAGGTAATGAAATGGCATTATGGGTATTATGGGTCTGCATTAATGAATCGGCCAGATATCGATATGCTGGCCACCGTG
CATGTGACCTCGCACCCCCGCAAGACATGGCCCGAGTTCGAGCACAACGTCATGACCCGATGCAATGTGCACCTGGGGTCCCG
CCGAGGCATGTTCATGCCCTACCAGTGCAACATGCAATTTGTGAAGGTGCTGCTGGAGCCCGATGCCATGTCCAGAGTGAGCC
TGACGGGGTGTTTGACATGAATGTGGAGCTGTGGAAAATTCTGAGATATGATGAATCCAAGACCAGGTGCCGGGCCTGCGA
ATGCGGAGGCAAGCACGCCAGGCTTCAGCCCGTGTGTGTGGAGGTGACGGAGGACCTGCGACCCGATCATTTGGTGTTGTCC
TGCAACGGGACGGAGTTCGGCTCCAGCGGGGAAGAATCTGACTAGAGTGAGTAGTGTTTGGGGGAGGTGGAGGGCTTGTAT
GAGGGGCAGAATGACTAAAATCTGTGTTTTTCTGTGTGTTGCAGCAGCATGAGCGGAAGCGCCTCCTTTGAGGGAGGGGTAT
TCAGCCCTTATCTGACGGGGCGTCTCCCCTCCTGGGCGGGAGTGCGTCAGAATGTGATGGGATCCACGGTGGACGGCCGGCC
CGTGCAGCCCGCGAACTCTTCAACCCTGACCTACGCGACCCTGAGCTCCTCGTCCGTGGACGCAGCTGCCGCCGCAGCTGCTG
CTTCCGCCGCCAGCGCCGTGCGCGGAATGGCCCTGGGCGCCGGCTACTACAGCTCTCTGGTGGCCAACTCGACTTCCACCAAT
AATCCCGCCAGCCTGAACGAGGAGAAGCTGCTGCTGCTGATGGCCCAGCTCGAGGCCCTGACCCAGCGCCTGGGCGAGCTGA
CCCAGCAGGTGGCTCAGCTGCAGGCGGAGACGCGGGCCGCGGTTGCCACGGTGAAAACCAAATAAAAAATGAATCAATAAAT
AAACGGAGACGGTTGTTGATTTTAACACAGAGTCTTGAATCTTTATTTGATTTTTCGCGCGCGGTAGGCCCTGGACCACCGGTC
TCGATCATTGAGCACCCGGTGGATTTTTTCCAGGACCCGGTAGAGGTGGGCTTGGATGTTGAGGTACATGGGCATGAGCCCGT
CCCGGGGGTGGAGGTAGCTCCATTGCAGGGCCTCGTGCTCGGGGGTGGTGTTGTAAATCACCCAGTCATAGCAGGGGCGCA
GGGCGTGGTGCTGCACGATGTCCTTGAGGAGGAGACTGATGGCCACGGGCAGCCCCTTGGTGTAGGTGTTGACGAACCTGTT
GAGCTGGGAGGGATGCATGCGGGGGAGATGAGATGCATCTTGGCCTGGATCTTGAGATTGGCGATGTTCCCGCCCAGATCC
CGCCGGGGGTTCATGTTGTGCAGGACCACCAGCACGGTGTATCCGGCGCACTTGGGGAATTTGTCATGCAACTTGGAAGGGA
AGGCGTGAAAGAATTTGGAGACGCCCTTGTGACCGCCCAGGTTTTCCATGCACTCATCCATGATGATGGCGATGGGCCCGTGG
GCGGCGGCCTGGGCAAAGACGTTTCGGGGGTCGGACACATCGTAGTTGTGGTCCTGGGTGAGCTCGTCATAGGCCATTTTAA
TGAATTTGGGGCGGAGGGTGCCCGACTGGGGACGAAGGTGCCCTCGATCCCGGGGGCGTAGTTGCCCTCGCAGATCTGCAT
CTCCCAGGCCTTGAGCTCGGAGGGGGGATCATGTCCACCTGCGGGGCGATGAAAAAAACGGTTTCCGGGGCGGGGAGAT
GAGCTGGGCCGAAAGCAGGTTCCGGAGCAGCTGGGACTTGCCGCAGCCGGTGGGGCCGTAGATGACCCCGATGACCGGCTG
CAGGTGGTAGTTGAGGGAGAGACAGCTGCCGTCCTCGCGGAGGAGGGGGCCACCTCGTTCATCATCTCGCGCACATGCATG
TTCTCGCGCACGAGTTCCGCCAGGAGGCGCTCGCCCCCAGCGAGAGGAGCTCTTGCAGCGAGGCGAAGTTTTTCAGCGGCTT
GAGYCCGTCGGCCATGGGCATTTTGGAGAGGGTCTGTTGCAAGAGTTCCAGACGGTCCCAGAGCTCGGTGATGTGCTCTAGG
GCATCTCGATCCAGCAGACCTCCTCGTTTCGCGGGTTGGGGCGACTGCGGGAGTAGGGCACCAGGCGATGGGCGTCCAGCGA
GGCCAGGGTCCGGTCCTTCCAGGGTCGCAGGGTCCGCGTCAGCGTGGTCTCCGTCACGGTGAAGGGGTGCGCGCCGGGCTG
GGCGCTTGCGAGGGTGCGCTTCAGGCTCATCCGGCTGGTCGAGAACCGCTCCCGGTCGGCGCCCTGCGCGTCGGCCAGGTAG
CAATTGAGCATGAGTTCGTAGTTGAGCGCCTCGGCCGCGTGGCCCTTGGCGCGGAGCTTACCTTTGGAAGTGTGTCCGCAGAC
GGGACAGAGGAGGGACTTGAGGGCGTAGAGCTTGGGGGCGAGGAAGACGGACTCGGGGGCGTAGGCGTCCGCGCCGCAG
CTGGCGCAGACGGTCTCGCACTCCACGAGCCAGGTGAGGTCGGGCCGGTTGGGGTCAAAAACGAGGTTTCCTCCGTGCTTTTT
GATGCGTTTCTTACCTCTGGTCTCCATGAGCTCGTGTCCCGCTGGGTGACAAAGAGGCTGTCCGTGTCCCGTAGACCGACTT
TATGGGCCGGTCCTCGAGCGGGGTGCCGCGGTCCTCGTCGTAGAGGAACCCCGCCCACTCCGAGACGAAGGCCCGGGTCCAG
GCCAGCACGAAGGAGGCCACGTGGGAGGGGTAGCGGTCGTTGTCCACCAGCGGGTCCACCTTCTCCAGGGTATGCAAGCACA
TGTCCCCCTCGTCCACATCCAGGAAGGTGATTGGCTTGTAAGTGTAGGCCACGTGACCGGGGGTCCCGGCCGGGGGGTATA
AAAGGGGGCGGGCCCCTGCTCGTCCTCACTGTCTTCCGGATCGCTGTCCAGGAGCGCCAGCTGTTGGGGTAGGTATTCCCTCT
CGAAGGCTGGCATAACCTCGGCACTCAGGTTGTCAGTTTCTAGAAACGAGGAGGATTTGATATTGACGGTGCCGTTGGAGAC
GCCTTTCATGAGCCCCTCGTCCATCTGGTCAGAAAAGACGATCTTTTTGTTGTCGAGCTTGGTGGCGAAGGAGCCGTAGAGGG
CGTTGGAGAGGAGCTTGGCGATGGAGCGCATGGTCTGGTTCTTTTCCTTGTCGGCGCGCTCCTTGGCGGCGATGTTGAGCTGC
ACGTACTCGCGCGCCACGCACTTCCATTCGGGGAAGACGGTGGTGAGCTCGTCGGGCACGATTCTGACCCGCCAGCCGCGGTT
GTGCAGGGTGATGAGGTCCACGCTGGTGGCCACCTCGCCGCGCAGGGGCTCGTTGGTCCAGCAGAGGCGCCCGCCCTTGCGC
GAGCAGAAGGGGGGCAGCGGGTCCAGCATGAGCTCGTCGGGGGGTCGGCGTCCACGGTGAAGATGCCGGGCAGAAGCTC
GGGGTCGAAGTAGCTGATGCAGGTGTCCAGATCGTCCAGCGCCGCTTGCCAGTCGCGCACGGCCAGCGCGCGCTCGTAGGGG
CTGAGGGGCGTGCCCAGGGCATGGGTGCGTGAGCGCGGAGGCGTACATGCCGCAGATGTCGTAGACGTAGAGGGGCTCC
TCGAGGACGCCGATGTAGGTGGGGTAGCAGCGCCCCCGCGGATGCTGGCGCGCACGTAGTCGTACAGCTCGTGCGAGGGC
GCGAGGAGCCCCGTGCCGAGGTTGGAGCGTTGCGGCTTTTCGGCGCGGTAGACGATCGGCGGAAGATGGCGTGGGAGTTG
GAGGAGATGGTGGGCCTCTGGAAGATGTTGAAGTGGGCGTGGGGCAGGCCGACCGAGTCCCTGATGAAGTGGGCGTAGGA
GTCCTGCAGCTTGGCGACGAGCTCGGCGGTGACGAGGACGTCCAGGGCGCAGTAGTCGAGGGTCTCTTGGATGATGTCGTAC
TTGAGCTGGCCCTTCTGCTTCCACAGCTCGCGGTTGAGAAGGAACTCTTCGCGGTCCTTCCAGTACTCTTCGAGGGGGAACCCG
```

Fig. 27C

```
TCCTGATCGGCACGGTAAGAGCCCACCATGTAGAACTGGTTGACGGCCTTGTAGGCGCAGCAGCCCTTCTCCACGGGGAGGG
CGTAAGCTTGTGCGGCCTTGCGCAGGGAGGTGTGGGTGAGGGCGAAGGTGTCGCGCACCATGACCTTGAGGAACTGGTGCT
TGAAGTCGAGGTCGTCGCAGCCGCCCTGCTCCCAGAGCTGGAAGTCCGTGCGCTTCTTGTAGGCGGGGTTGGGCAAAGCGAA
AGTAACATCGTTGAAGAGGATCTTGCCCGCGCGGGGCATGAAGTTGCGAGTGATGCGGAAAGGCTGGGGCACCTCGGCCCG
GTTGTTGATGACCTGGGCGGCGAGGACGATCTCGTCGAAGCCGTTGATGTTGTGCCCGACGATGTAGAGTTCCACGAATCGC
GGGCGGCCCTTAACGTGGGGCAGCTTCTTGAGCTCGTCGTAGGTGAGCTCGGCGGGGTCGCTGAGCCCGTGCTGCTCGAGGG
CCCAGTCGGCGACGTGGGGGTTGGCGCTGAGGAAGGAAGTCCAGAGATCCACGGCCAGGGCGGTCTGCAAGCGGTCCCGGT
ACTGACGGAACTGCTGGCCCACGGCCATTTTTTCGGGGGTGACGCAGTAGAAGGTGCGGGGGTCGCCGTGCCAGCGGTCCCA
CTTGAGCTGGAGGGCGAGGTCGTGGGCGAGCTCGACGAGCGGCGGGTCCCCGGAGAGTTTCATGACCAGCATGAAGGGGAC
GAGCTGCTTGCCGAAGGACCCCATCCAGGTGTAGGTTTCCACATCGTAGGTGAGGAAGAGCCTTTCGGTGCGAGGATGCGAG
CCGATGGGGAAGAACTGGATCTCCTGCCACCAGTTGGAGGAATGGCTGTTGATGTGATGGAAGTAGAAATGCCGACGGCGC
GCCGAGCACTCGTGCTTGTGTTTATACAAGCGTCCGCAGTGCTCGCAACGCTGCACGGGATGCACGTGCTGCACGAGCTGTAC
CTGGGTTCCTTTGACGAGGAATTTCAGTGGGCAGTGGAGCGCTGGCGGCTGCATCTGGTGCTGTACTACGTCCTGGCCATCGG
CGTGGCCATCGTCTGCCTCGATGGTGGTCATGCTGACGAGCCCGCGCGGGAGGCAGGTCCAGACTTCGGCTCGGACGGGTCG
GAGAGCGAGGACGAGGGCGCGCAGGCCGGAGCTGTCCAGGGTCCTGAGACGCTGCGGAGTCAGGTCAGTGGGCAGCGGCG
GCGCGCGGTTGACTTGCAGGAGCTTTTCCAGGGCGCGCGGGAGGTCCAGATGGTACTTGATCTCCACGGCGCCGTTGGTGGC
GACGTCCACGGCTTGCAGGGTCCCGTGCCCCTGGGGCGCCACCACCGTGCCCCGTTTCTTCTTGGGCGCTGCTTCCATGCCGGT
CAGAAGCGGCGGCGAGGACGCGCGCCGGGCGGCAGGGGCGGCTCGGGACCCGGAGGCAGGGCGGCAGGGGCACGTCGG
CGCCGCGCGGGCAGGTTCTGGTACTGCGCCCGGAGAAGACTGGCGTGAGCGACGACGCGACGGTTGACGTCCTGGATCT
GACGCCTCTGGGTGAAGGCCACGGGACCCGTGAGTTTGAACCTGAAAGAGAGTTCGACAGAATCAATCTCGGTATCGTTGAC
GGCGGCCTGCCGCAGGATCTCTTGCACGTCGCCCGAGTTGTCCTGGTAGGCGATCTCGGTCATGAACTGCTCGATCTCCTCCTC
CTGAAGGTCTCCGCGGCCGGCGCGCTCGACGGTGGCCGCGAGGTCGTTGGAGATGCGGCCCATGAGCTGCGAGAAGGCGTT
CATGCCGGCCTCGTTCCAGACGCGGCTGTAGACCACGGCTCCGTCGGGGTCGCGCGCGCATGACCACCTGGGCGAGGTTG
AGCTCGACGTGGCGCGTGAAGACCGCGTAGTTGCAGAGGCGCTGGTAGAGGTAGTTGAGCGTGGTGGCGATGTGCTCGGTG
ACGAAGAAGTACATGATCCAGCGGCGGAGCGGCATCTCGCTGACGTCGCCCAGGGCTTCCAAGCGCTCCATGGCCTCGTAGA
AGTCCACGGCGAAGTTGAAAAACTGGGAGTTGCGCGCCGAGACGGTCAACTCCTCCTCCAGAAGACGGATGAGCTCAGCGAT
GGTGGCGCGCACCTCGCGCTCGAAGGCCCCGGGGGGCTCCTCTTCTTCCATCTCTTCCTCCTCCACTAACATCTCTTCTACTTCC
TCCTCAGGAGGCGGCGGCGGGGAGGGGCCCTGCGTCGCCGGCGGCGCACGGGCAGACGGTCGATGAAGCGCTCGATGGT
CTCCCCGCGCCGGCGACGCATGGTCTCGGTGACGGCGCGCCCGTCCTCGCGGGCCGCAGCGTGAAGACGCCGCCGCGCATC
TCCAGGTGGCCGCCGGGGGGGTCTCCGTTGGGCAGGGAGAGGGCGCTGACGATGCATCTTATCAATTGGCCCGTAGGGACTC
CGCGCAAGGACCTGAGCGTCTCGAGATCCACGGGATCCGAAAACCGCTGAACGAAGGCTTCGAGCCAGTCGCAGTCGCAAGG
TAGGCTGAGCCCGGTTTCTTGTTCTTCGGGGATTTCGGGAGGCGGGCGGGCGATGCTGCTGGTGATGAAGTTGAAGTAGGCG
GTCCTGAGACGGCGGATGGTGGCGAGGAGCACCAGGTCCTTGGGCCCGGCTTGCTGGATGCGCAGACGGTCGGCCATGCCC
CAGGCGTGGTCCTGACACCTGGCGAGGTCCTTGTAGTAGTCCTGCATGAGCCGCTCCACGGGCACCTCCTCCTCGCCCGCGCG
GCCGTGCATGCGCGTGAGCCCGAACCCGCGCTGGGGCTGGACGAGCGCCAGGTCGGCGACGACGCGCTCGGCGAGGATGGC
CTGCTGTATCTGGGTGAGGGTGGTCTGGAAGTCGTCGAAGTCGACGAAGCGGTGGTAGGCTCCGGTGTTGATGGTATAGGA
GCAGTTGGCCATGACGGACCAGTTGACGGTCTGGTGGCCGGGTCGCACGAGCTCGTGGTACTTGAGGCGCGAGTAGGCGCG
CGTGTCGAAGATGTAGTCGTTGCAGGTGCGCACGAGGTACTGGTATCCGACGAGGAAGTGCGGCGGCGGCTGGCGGTAGAG
CGGCCATCGCTCGGTGGCGGGGCGCCGGGCGCGAGGTCCTCGAGCATGAGGCGGTGGTAGCCGTAGATGTACCTGGACAT
CCAGGTGATGCCGGCGGCGGTGGTGGAGGCGCGCGGGAACTCGCGGACGCGGTTCCAGATGTTGCGCAGCGGCAGGAAGT
AGTTCATGGTGGCCGCGGTCTGGCCCGTGAGGCGCGCGCAGTCGTGGATGCTCTAGACATACGGGCAAAACGAAAGCGGTC
AGCGGCTCGACTCCGTGGCCTGGAGGCTAAGCGAACGGGTTGGGCTGCGCGTGTACCCCGGTTCGAATCTCGAATCAGGCTG
GAGCCGCAGCTAACGTGGTACTGGCACTCCCGTCTCGACCCAAGCCTGCTAACGAAACCTCCAGGATACGGAGGCGGGTCGTT
TTTTGGCCTTGGTCGCTGGTCATGAAAAACTAGTAAGCGCGGAAAGCGACCGCCCGCGATGGCTCGCTGCCGTAGTCTGGAG
AAAGAATCGCCAGGGTTGCGTTGCGGTGTGCCCCGGTTCGAGCCTCAGCGCTCGGCGCCGGCCGGATTCCGCGGCTAACGTG
GGCGTGGCTGCCCCGTCGTTTCCAAGACCCCTTAGCCAGCCGACTTCTCCAGTTACGGAGCGAGCCCCTCTTTTTCTTGTGTTTT
TGCCAGATGCATCCCGTACTGCGGCAGATGCGCCCCACCCTCCACCTCAACCGCCCTACCGCCGCAGCAGCAGCAACAGCC
GGCGCTTCTGCCCCCGCCCAGCAGCAGCCAGCCACTACCGCGGCGGCCGCCGTGAGCGGAGCCGGCGTTCAGTATGACCTG
GCCTTGGAAGAGGGCGAGGGGCTGGCGCGGCTGGGGCGTCGTCGCCGGAGCGGCACCCGCGCGTGCAGATGAAAAGGGA
CGCTCGCGAGGCCTACGTGCCCAAGCAGAACCTGTTCAGAGACAGGAGCGGCGAGGAGCCCGAGGAGATGCGCGCCTCCCG
CTTCCACGCGGGGCGGGAGCTGCGGCGCGGCCTGGACCGAAAGCGGGTGCTGAGGGACGAGGATTTCGAGGCGGACGAGC
```

Fig. 27D

```
TGACGGGGATCAGCCCCGCGCGCGCGCACGTGGCCGCGGCCAACCTGGTCACGGCGTACGAGCAGACCGTGAAGGAGGAGA
GCAACTTCCAAAAATCCTTCAACAACCACGTGCGCACGCTGATCGCGCGCGAGGAGGTGACCCTGGGCCTGATGCACCTGTGG
GACCTGCTGGAGGCCATCGTGCAGAACCCCACGAGCAAGCCGCTGACGGCGCAGCTGTTTCTGGTGGTGCAGCACAGTCGGG
ACAACGAGACGTTCAGGGAGGCGCTGCTGAATATCACCGAGCCCGAGGGCCGCTGGCTCCTGGACCTGGTGAACATTCTGCA
GAGCATCGTGGTGCAGGAGCGCGGGCTGCCGCTGTCCGAGAAGCTGGCGGCTATCAACTTCTCGGTGCTGAGCCTGGGCAAG
TACTACGCTAGGAAGATCTACAAGACCCCGTACGTGCCCATAGACAAGGAGGTGAAGATCGACGGGTTTTACATGCGCATGA
CCCTGAAAGTGCTGACCCTGAGCGACGATCTGGGGGTGTACCGCAACGACAGGATGCACCGCGCGGTGAGCGCCAGCCGCC
GGCGCGAGCTGAGCGACCAGGAGCTGATGCACAGCCTGCAGCGGGCCCTGACCGGGGCCGGGACCGAGGGGGAGAGCTAC
TTTGACATGGGCGCGGACCTGCGCTGGCAGCCCAGCCGCCGGGCCTTGGAAGCTGCCGGCGGTTCCCCCTACGTGGAGGAGG
TGGACGATGAGGAGGAGGAGGGCGAGTACCTGGAAGACTGATGGCGCGACCGTATTTTGCTAGATGCAGCAACAGCCACC
GCCTCCTGATCCCGCGATGCGGGCGGCGCTGCAGAGCCAGCCGTCCGGCATTAACTCCTCGGACGATTGGACCCAGGCCATGC
AACGCATCATGGCGCTGACGACCCGCAATCCCGAAGCCTTTAGACAGCAGCCTCAGGCCAACCGGCTCTCGGCCATCCTGGAG
GCCGTGGTGCCCTCGCGCTCGAACCCCACGCACGAGAAGGTGCTGGCCATCGTGAACGCGCTGGTGGAGAACAAGGCCATCC
GCGGCGACGAGGCCGGGCTGGTGTACAACGCGCTGCTGGAGCGCGTGGCCCGCTACAACAGCACCAACGTGCAGACGAACC
TGGACCGCATGGTGACCGACGTGCGCGAGGCGGTGTCGCAGCGCGAGCGGTTCCACCGCGAGTCGAACCTGGGCTCCATGGT
GGCGCTGAACGCCTTCCTGAGCACGCAGCCCGCCAACGTGCCCCGGGGCCAGGAGGACTACACCAACTTCATCAGCGCGCTG
CGGCTGATGGTGGCCGAGGTGCCCCAGAGCGAGGTGTACCAGTCGGGGCCGGACTACTTCTTCCAGACCAGTCGCCAGGGCT
TGCAGACCGTGAACCTGAGCCAGGCTTTCAAGAACTTGCAGGGACTGTGGGCGTGCAGGCCCCGGTCGGGGACCGCGCGA
CGGTGTCGAGCCTGCTGACGCCGAACTCGCGCCTGCTGCTGCTGCTGGTGGCGCCCTTCACGGACAGCGGCAGCGTGAGCCG
CGACTCGTACCTGGGCTACCTGCTTAACCTGTACCGCGAGGCCATCGGGCAGGCGCACGTGGACGAGCAGACCTACCAGGAG
ATCACCCACGTGAGCCGCGCGCTGGGCCAGGAGGACCCGGGCAACCTGGAGGCCACCCTGAACTTCCTGCTGACCAACCGGT
CGCAGAAGATCCCGCCCCAGTACGCGCTGAGCACCGAGGAGGAGCGCATCCTGCGCTACGTGCAGCAGAGCGTGGGGCTGTT
CCTGATGCAGGAGGGGGCCACGCCCAGCGCCGCGCTCGACATGACCGCGCGCAACATGGAGCCCAGCATGTACGCTCGCAAC
CGCCCGTTCATCAATAAGCTGATGGACTACTTGCATCGGGCGGCCGCCATGAACTCGGACTACTTTACCAACGCCATCTTGAAC
CCGCACTGGCTCCCGCCGCCCGGGTTCTACACGGGCGAGTACGACATGCCCGACCCCAACGACGGGTTCCTGTGGGACGACG
TGGACAGCAGCGTGTTCTCGCCGCGCCCCGCCACCACCGTGTGGAAGAAAGAGGGCGGGGACCGGCGGCCGTCCTCGGCGC
TGTCCGGTCGCGCGGGTGCTGCCGCGGCGGTGCCTGAGGCCGCCAGCCCCTTCCCGAGCCTGCCCTTTTCGCTGAACAGCGTG
CGCAGCAGCGAGCTGGGTCGGCTGACGCGGCCGCGCCTGCTGGGCGAGGAGGAGTACCTGAACGACTCCTTGTTGAGGCCC
GAGCGCGAGAAGAACTTCCCCAATAACGGGATAGAGAGCCTGGTGGACAAGATGAGCCGCTGGAAGACGTACGCGCACGAG
CACAGGGACGAGCCCCGAGCTAGCAGCAGCGCAGGCACCCGTAGACGCCAGCGACACGACAGGCAGCGGGGTCTGGTGTGG
GACGATGAGGATTCCGCCGACGACAGCAGCGTGTTGGACTTGGGTGGGAGTGGTGGTGGTAACCCGTTCGCTCACTTGCGCC
CCCGTATCGGGCGCCTGATGTAAGAATCTGAAAAAATAAAAAACGGTACTCACCAAGGCCATGGCGACCAGCGTGCGTTCTTC
TCTGTTGTTTGTAGTAGTATGATGAGGCGCGTGTACCCGGAGGGTCCTCCTCCCTCGTACGAGAGCGTGATGCAGCAGGCGGT
GGCGGCGGCGATGCAGCCCCGCTGGAGGCGCCTTACGTGCCCCCGCGGTACCTGGCGCCTACGGAGGGGCGGAACAGCAT
TCGTTACTCGGAGCTGGCACCCTTGTACGATACCACCCGGTTGTACCTGGTGGACAACAAGTCGGCGGACATCGCCTCGCTGA
ACTACCAGAACGACCACAGCAACTTCCTGACCACCGTGGTGCAGAACAACGATTTCACCCCCACGGAGGCCAGCACCCAGACC
ATCAACTTTGACGAGCGCTCGCGGTGGGGCGGCCAGCTGAAAACCATCATGCACACCAACATGCCCAACGTGAACGAGTTCAT
GTACAGCAACAAGTTCAAGGCGCGGGTGATGGTCTCGCGCAAGACCCCCAATGGGGTCGCGGTGGATGAGAATTATGATGGT
AGTCAGGACGAGCTGACTTACGAGTGGGTGGAGTTTGAGCTGCCCGAGGGCAACTTCTCGGTGACCATGACCATCGATCTGA
TGAACAACGCCATCATCGACAACTACTTGGCGGTGGGGCGTCAGAACGGGGTGCTGGAGAGCGACATCGGCGTGAAGTTCG
ACACGCGCAACTTCCGGCTGGGCTGGGACCCCGTGACCGAGCTGGTGATGCCGGGCGTGTACACCAACGAGGCCTTCCACCC
CGACATCGTCCTGCTGCCCGGCTGCGGCGTGGACTTCACCGAGAGCCGCCTCAGCAACCTGCTGGGCATCCGCAAGCGGCAG
CCCTTCCAGGAGGGCTTCCAGATCCTGTACGAGGACCTGGAGGGGGGCAACATCCCCGCGCTCTTGGATGTCGAAGCCTATGA
GAAAAGCAAGGAGGAGGCCGCCGCAGCGGCGACCGCAGCCGTGGCCACCGCCTCTACCGAGGTGCGGGGCGATAATTTTGC
TAGCGCCGCGGCAGTGGCCGAGGCGGCTGAAACCGAAAGTAAGATAGTCATCCAGCCGGTGGAGAAGGACAGCAAGGACA
GGAGCTACAACGTGCTCGCGGACAAGAAAAACACCGCCTACCGCAGCTGGTACCTGGCCTACAACTACGGCGACCCCGAGAA
GGGCGTGCGCTCCTGGACGCTGCTCACCACCTCGGACGTCACCTGCGGCGTGGAGCAAGTCTACTGGTCGCTGCCCGACATGA
TGCAAGACCCGGTCACCTTCCGCTCCACGCGTCAAGTTAGCAACTACCCGGTGGTGGGCGCCGAGCTCCTGCCCGTCTACTCCA
AGAGCTTCTTCAACGAGCAGGCCGTCTACTCGCAGCAGCTGCGCGCCTTCACCTCGCTCACGCACGTCTTCAACCGCTTCCCCG
AGAACCAGATCCTCGTCCGCCCGCCCGCGCCCACCATTACCACCGTCAGTGAAAACGTTCCTGCTCTCACAGATCACGGGACCC
TGCCGCTGCGCAGCAGTATCCGGGGAGTCCAGCGCGTGACCGTCACTGACGCCAGACGCCGCACCTGCCCCTACGTCTACAAG
```

Fig. 27E

```
GCCCTGGGCGTAGTCGCGCCGCGCGTCCTCTCGAGCCGCACCTTCTAAAAAATGTCCATTCTCATCTCGCCCAGTAATAACACC
GGTTGGGGCCTGCGCGCGCCCAGCAAGATGTACGGAGGCGCTCGCCAACGCTCCACGCAACACCCCGTGCGCGTGCGCGGGC
ACTTCCGCGCTCCCTGGGGCGCCCTCAAGGGCCGCGTGCGCTCGCGCACCACCGTCGACGACGTGATCGACCAGGTGGTGGC
CGACGCGCGCAACTACACGCCCGCCGCCGCGCCCGCCTCCACCGTGGACGCCGTCATCGACAGCGTGGTGGCCGATGCGCGC
CGGTACGCCCGCGCCAAGAGCCGGCGGCGGCGCATCGCCCGGCGGCACCGGAGCACCCCGCCATGCGCGCGGCGCGAGCC
TTGCTGCGCAGGGCCAGGCGCACGGGACGCAGGGCCATGCTCAGGGCGGCCAGACGCGCGGCCTCCGGCAGCAGCAGCGCC
GGCAGGACCGCAGACGCGCGGCCACGGCGGCGGCGGCGGCCATCGCCAGCATGTCCCGCCCGCGGCGCGGCAACGTGTAC
TGGGTGCGCGACGCCGCCACCGGTGTGCGCGTGCCCGTGCGCACCCGCCCCCCTCGCACTTGAAGATGCTGACTTCGCGATGT
TGATGTGTCCCAGCGGCGAGGAGGATGTCCAAGCGCAAATACAAGGAAGAGATGCTCCAGGTCATCGCGCCTGAGATCTACG
GCCCCGCGGTGAAGGAGGAAAGAAAGCCCCGCAAACTGAAGCGGGTCAAAAAGGACAAAAAGGAGGAGGAAGATGTGGAC
GGACTGGTGGAGTTTGTGCGCGAGTTCGCCCCCCGGCGGCGCGTGCAGTGGCGCGGGCGGAAAGTGAAACCGGTGCTGCGG
CCCGGCACCACGGTGGTCTTCACGCCCGGCGAGCGTTCCGGCTCCGCCTCCAAGCGCTCCTACGACGAGGTGTACGGGACG
AGGACATCCTCGAGCAGGCGGTCGAGCGTCTGGGCGAGTTTGCTTACGGCAAGCGCAGCCGCCCCGCGCCCTTGAAAGAGGA
GGCGGTGTCCATCCCGCTGGACCACGGCAACCCCACGCCGAGCCTGAAGCCGGTGACCCTGCAGCAGGTGCTGCCGAGCGCG
GCGCCGCGCCGGGGCTTCAAGCGCGAGGGCGGCGAGGATCTGTACCCGACCATGCAGCTGATGGTGCCCAAGCGCCAGAAG
CTGGAGGACGTGCTGGAGCACATGAAGGTGGACCCCGAGGTGCAGCCCGAGGTCAAGGTGCGGCCCATCAAGCAGGTGGCC
CCGGGCCTGGGCGTGCAGACCGTGGACATCAAGATCCCCACGGAGCCCATGGAAACGCAGACCGAGCCCGTGAAGCCCAGC
ACCAGCACCATGGAGGTGCAGACGGATCCCTGGATGCCGGCGCCGGCTTCCACCACTCGCCGAAGACGCAAGTACGGCGCGG
CCAGCCTGCTGATGCCCAACTACGCGCTGCATCCTTCCATCATCCCCACGCCGGGCTACCGCGGCACGCGCTTCTACCGCGGCT
ACACCAGCAGCCGCCGCAAGACCACCACCCGCCGCCGCCGTCGTCGCACCCGCCGCAGCAGCACCGCGACTTCCGCCGCCGCC
CTGGTGCGGAGAGTGTACCGCAGCGGGCGCGAGCCTCTGACCCTGCCGCGCGCGCGCTACCACCCGAGCATCGCCATTTAACT
CTGCCGTCGCCTCCTACTTGCAGATATGGCCCTCACATGCCGCCTCCGCGTCCCCATTACGGGCTACCGAGGAAGAAAGCCGC
GCCGTAGAAGGCTGACGGGGAACGGGCTGCGTCGCCATCACCACCGGCGGCGGCGCGCCATCAGCAAGCGGTTGGGGGGA
GGCTTCCTGCCCGCGCTGATCCCCATCATCGCCGCGGCGATCGGGGCGATCCCCGGCATAGCTTCCGTGGCGGTGCAGGCCTC
TCAGCGCCACTGAGACACAGCTTGGAAAATTTGTAATAAAAAAATGGACTGACGCTCCTGGTCCTGTGATGTGTGTTTTTAGAT
GGAAGACATCAATTTTTCGTCCCTGGCACCGCGACACGGCACGCGGCCGTTTATGGGCACCTGGAGCGACATCGGCAACAGCC
AACTGAACGGGGCGCCTTCAATTGGAGCAGTCTCTGGAGCGGGCTTAAGAATTTCGGGTCCACGCTCAAAACCTATGGCAAC
AAGGCGTGGAACAGCAGCACAGGGCAGGCGCTGAGGGAAAAGCTGAAAGAGCAGAACTTCCAGCAGAAGGTGGTCGATGG
CCTGGCCTCGGGCATCAACGGGGTGGTGGACCTGGCCAACCAGGCCGTGCAGAAACAGATCAACAGCCGCCTGGACGCGGTC
CCGCCCGCGGGGTCCGTGGAGATGCCCCAGGTGGAGGAGGAGCTGCCTCCCCTGGACAAGCGCGGCGACAAGCGACCGCGT
CCCGACGCGGAGGAGACGCTGCTGACGCACACGGACGAGCCGCCCCCGTACGAGGAGGCGGTGAAACTGGGTCTGCCCACC
ACGCGGCCCGTGGCGCCTCTGGCCACCGGGGTGCTGAAACCCAGCAGCAGCAGCCAGCCCGCGACCCTGGACTTGCCTCCGC
CTGCTTCCCGCCCCTCCACAGTGGCTAAGCCCCTGCCGCCGGTGGCCGTCGCGTCGCGCGCCCCCGAGGCCGCCCCCAGGCG
AACTGGCAGAGCACTCTGAACAGCATCGTGGGTCTGGGAGTGCAGAGTGTGAAGCGCCGCCGCTGCTATTAAAAGACACTGT
AGCGCTTAACTTGCTTGTCTGTGTGTATATGTATGTCCGCCGACCAGAAGGAGGAAGAGGCGCGTCGCCGAGTTGCAAGATG
GCCACCCCATCGATGCTGCCCCAGTGGGCGTACATGCACATCGCCGGACAGGACGCTTCGGAGTACCTGAGTCCGGGTCTGGT
GCAGTTCGCCCGCGCCACAGACACCTACTTCAGTCTGGGGAACAAGTTTAGGAACCCCACGGTGGCGCCCACGCACGATGTGA
CCACCGACCGCAGCCAGCGGCTGACGCTGCGCTTCGTGCCCGTGGACCGCGAGGACAACACCTACTCGTACAAAGTGCGCTAC
ACGCTGGCCGTGGGCGACAACCGCGTGCTGGACATGGCCAGCACCTACTTTGACATCCGCGGCGTGCTGGATCGGGGCCCA
GCTTCAAACCCTACTCCGGCACCGCCTACAACAGCCTGGCTCCCAAGGGAGCGCCCAACACTTGCCAGTGGACATATAAAGCT
GGTGATACTGATACAGAAAAAACCTATACATATGGAAATGCACCTGTGCAAGGCATTAGCATTACAAAGGATGGTATTCAACT
TGGAACTGACAGCGATGGTCAGGCAATCTATGCAGACGAAACTTATCAACCAGAGCCTCAAGTGGGTGATGCTGAATGGCAT
GACATCACTGGTACTGATGAAAAATATGGAGGCAGAGCTCTTAAGCCTGACACCAAAATGAAGCCTTGCTATGGTTCTTTTGCC
AAGCCTACCAATAAAGAAGGAGGCCAGGCAAATGTGAAAACCGAAACAGGCGGTACCAAAGAATATGACATTGACATGGCAT
TCTTCGATAATCGAAGTGCAGCTGCCGCCGGCCTAGCCCCAGAAATTGTTTTGTATACTGAGAATGTGGATCTGGAAACTCCAG
ATACCCATATTGTATACAAGGCAGGTACAGATGACAGTAGCTCTTCTATCAATTTGGGTCAGCAGTCCATGCCCAACAGACCCA
ACTACATTGGCTTCAGAGACAACTTTATCGGTCTGATGTACTACAACAGCACTGGCAATATGGGTGTACTGGCTGGACAGGCC
TCCCAGCTGAATGCTGTGGTGGACTTGCAGGACAGAAACACCGAACTGTCCTACCAGCTCTTGCTTGACTCTCTGGGTGACAG
AACCAGGTATTTCAGTATGTGGAATCAGGCGGTGGACAGTTATGACCCGATGTGCGCATTATTGAAAATCACGGTGTGGAG
GATGAACTTCCTAACTATTGCTTCCCCCTGGATGCTGTGGGTAGAACTGATACTTACCAGGGAATTAAGGCCAATGGTGATAAT
CAAACCACCTGGACCAAAGATGATACTGTTAATGATGCTAATGAATTGGGCAAGGGCAATCCTTTCGCCATGGAGATCAACAT
```

Fig. 27F

```
CCAGGCCAACCTGTGGCGGAACTTCCTCTACGCGAACGTGGCGCTGTACCTGCCCGACTCCTACAAGTACACGCCGGCCAACA
TCACGCTGCCCACCAACACCAACACCTACGATTACATGAACGGCCGCGTGGTGGCGCCCTCGCTGGTGGACGCCTACATCAAC
ATCGGGGCGCGCTGGTCGCTGGACCCCATGGACAACGTCAACCCCTTCAACCACCACCGCAACGCGGGCCTGCGATACCGCTC
CATGCTCCTGGGCAACGGGCGCTACGTGCCCTTCCACATCCAGGTGCCCCAAAAGTTTTTCGCCATCAAGAGCCTCCTGCTCCT
GCCCGGGTCCTACACCTACGAGTGGAACTTCCGCAAGGACGTCAACATGATCCTGCAGAGCTCCCTCGGCAACGACCTGCGCA
CGGACGGGGCCTCCATGCCCTTCACCAGCATCAACCTCTACGCCACCTTCTTCCCCATGGCGCACAACACCGCCTCCACGCTCG
AGGCCATGCTGCGCAACGACACCAACGACCAGTCCTTCAACGACTACCTCTCGGCGGCCAACATGCTCTACCCCATCCCGGCCA
ACGCCACCAACGTGCCCATCTCCATCCCCTCGCGCAACTGGGCCGCCTTCCGCGGCTGGTCCTTCACGCGCCTCAAGACCCGCG
AGACGCCCTCGCTCGGCTCCGGGTTCGACCCCTACTTCGTCTACTCGGGCTCCATCCCCTACCTCGACGGCACCTTCTACCTCAA
CCACACCTTCAAGAAGGTCTCCATCACCTTCGACTCCTCCGTCAGCTGGCCCGGCAACGACGCCTCCTGACGCCCAACGAGTT
CGAAATCAAGCGCACCGTCGACGGAGAGGGGTACAACGTGGCCCAGTGCAACATGACCAAGGACTGGTTCCTGGTCCAGATG
CTGGCCCACTACAACATCGGCTACCAGGGCTTCTACGTGCCCGAGGGCTACAAGGACCGCATGTACTCCTTCTTCCGCAACTTC
CAGCCCATGAGCCGCCAGGTCGTGGACGAGGTCAACTACAAGGACTACCAGGCCGTCACCCTGGCCTACCAGCACAACAACTC
GGGCTTCGTCGGCTACCTCGCGCCCACCATGCGCCAGGGCCAGCCCTACCCCGCCAACTACCCCTACCCGCTCATCGGCAAGA
GCGCCGTCGCCAGCGTCACCCAGAAAAAGTTCCTCTGCGACCGGGTCATGTGGCGCATCCCCTTCTCCAGCAACTTCATGTCCA
TGGGCGCGCTCACCGACCTCGGCCAGAACATGCTCTACGCCAACTCCGCCCACGCGCTAGACATGAATTTCGAAGTCGACCCC
ATGGATGAGTCCACCCTTCTCTATGTTGTCTTCGAAGTCTTCGACGTCGTCCGAGTGCACCAGCCCCACCGCGGCGTCATCGAG
GCCGTCTACCTGCGCACGCCCTTCTCGGCCGGCAACGCCACCACCTAAGCCTCTTGCTTCTTGCAAGATGACGGCCTGCGCGGG
CTCCGGCGAGCAGGAGCTCAGGGCCATCCTCCGCGACCTGGGCTGCGGGCCCTGCTTCCTGGGCACCTTCGACAAGCGCTTCC
CGGGATTCATGGCCCCGCACAAGCTGGCCTGCGCCATCGTCAACACGGCCGGCCGCGAGACCGGGGGCGAGCACTGGCTGG
CCTTCGCCTGGAACCCGCGCTCCCACACCTGCTACCTCTTCGACCCCTTCGGGTTCTCGGACGAGCGCCTCAAGCAGATCTACC
AGTTCGAGTACGAGGGCCTGCTGCGTCGCAGCGCCCTGGCCACCGAGGACGCTGCGTCACCCTGGAAAAGTCCACCCAGAC
CGTGCAGGGTCCGCGCTCGGCCGCCTGCGGGCTCTTCTGCTGCATGTTCCTGCACGCCTTCGTGCACTGGCCCGACCGCCCAT
GGACAAGAACCCCACCATGAACTTGCTGACGGGGGTGCCCAACGGCATGCTCCAGTCGCCCCAGGTGGAACCCACCCTGCGC
CGCAACCAGGAGGCGCTCTACCGCTTCCTCAACGCCCACTCCGCCTACTTTCGCTCCCACCGCGCGCGCATCGAGAAGGCCACC
GCCTTCGACCGCATGAATCAAGACATGTAATCCGGTGTGTGTATGTGAATGCTTTATTCATCATAATAAACAGCACATGTTTAT
GCCACCTTCTCTGAGGCTCTGACTTTATTTAGAAATCGAAGGGGTTCTGCCGGCTCTCGGCATGGCCCGCGGGCAGGGATACG
TTGCGGAACTGGTACTTGGGCAGCCACTTGAACTCGGGGATCAGCAGCTTCGGCACGGGGAGGTCGGGGAACGAGTCGCTCC
ACAGCTTGCGCGTGAGTTGCAGGGCGCCCAGCAGGTCGGGCGCGGAGATCTTGAAATCGCAGTTGGGACCCGCGTTCTGCGC
GCGAGAGTTACGGTACACGGGGTTGCAGCACTGGAACACCATCAGGGCCGGGTGCTTCACGCTCGCCAGCACCGTCGCGTCG
GTGATGCCCTCCACGTCCAGATCCTCGGCGTTGGCCATCCCGAAGGGGGTCATCTTGCAGGTCTGCCGCCCCATGCTGGGCAC
GCAGCCGGGCTTGTGGTTGCAATCGCAGTGCAGGGGATCAGCATCATCTGGGCCTGCTCGGAGCTCATGCCCGGGTACATG
GCCTTCATGAAAGCCTCCAGCTGGCGGAAGGCCTGCTGCGCCTTGCCGCCCTCGGTGAAGAAGACCCCGCAGGACTTGCTAGA
GAACTGGTTGGTGGCGCAGCCAGCGTCGTGCACGCAGCAGCGCGCGTCGTTGTTGGCCAGCTGCACCACGCTGCGCCCCCAG
CGGTTCTGGGTGATCTTGGCCCGGTCGGGGTTCTCCTTCAGCGCGCGCTGCCCGTTCTCGCTCGCCACATCCATCTCGATCGTG
TGCTCCTTCTGGATCATCACGGTCCCGTGCAGGCACCGCAGCTTGCCCTCGGCCTCGGTGCACCCGTGCAGCCACAGCGCGCA
GCCGGTGCTCTCCCAGTTCTTGTGGGCGATCTGGGAGTGCGAGTGCACGAAGCCCTGCAGGAAGCGGCCCATCATCGTGGTC
AGGGTCTTGTTGCTGGTGAAGGTCAGCGGAATGCCGCGGTGCTCCTCGTTCACATACAGGTGGCAGATACGGCGGTACACCTC
GCCCTGCTCGGGCATCAGCTGGAAGGCGGACTTCAGGTCGCTCTCCACGCGGTACCGGTCCATCAGCAGCGTCATCACTTCCA
TGCCCTTCTCCCAGGCCGAAACGATCGGCAGGCTCAGGGGGTTCTTCACCGTTGTCATCTTAGTCGCCGCCGCCGAAGTCAGG
GGGTCGTTCTCGTCCAGGGTCTCAAACACTCGCTTGCCGTCCTTCTCGGTGATGCGCACGGGGGGAAAGCTGAAGCCCACGGC
CGCCAGCTCCTCCTCGGCCTGCCTTTCGTCCTCGCTGTCCTGGCTGATGTCTTGCAAAGGCACATGCTTGGTCTTGCGGGGTTTC
TTTTTGGGCGGCAGAGGCGGCGGCGGAGACGTGCTGGGCGAGCGCGAGTTCTCGCTCACCACGACTATTTCTTCTCCTTGGCC
GTCGTCCGAGACCACGCGGCGGTAGGCATGCCTCTTCTGGGGCAGAGGCGGAGGCGACGGGCTCTCGCGGTTCGGCGGGCG
GCTGGCAGAGCCCCTTCCGCGTTCGGGGGTGCGCTCCTGGCGGCGCTGCTCTGACTGACTTCCTCCGCGGCCGGCCATTGTGT
TCTCCTAGGGAGCAAGCATGGAGACTCAGCCATCGTCGCCAACATCGCCATCTGCCCCGCCGCCGCCGACGAGAACCAGCAG
CAGCAGAATGAAAGCTTAACCGCCCCGCCGCCCAGCCCCACCTCCGACGCCGCAGCCCAGACATGCAAGAGATGGAGGAAT
CCATCGAGATTGACCTGGGCTACGTGACGCCCGCGGAGCACGAGGAGGAGCTGGCAGCGCGCTTTTCAGCCCCGGAAGAGA
ACCACCAAGAGCAGCCAGAGCAGGAAGCAGAGAGCGAGCAGAACCAGGCTGGGCTCGAGCATGGCGACTACCTGAGCGGG
GCAGAGGACGTGCTCATCAAGCATCTGGCCCGCCAATGCATCATCGTCAAGGACGCGCTGCTCGACCGCGCCGAGGTGCCCCT
CAGCGTGGCGGAGCTCAGCCGCGCCTACGAGCGCAACCTCTTCTCGCCGCGCGTGCCCCCAAGCGCCAGCCCAACGGCACCT
```

Fig. 27G

```
GCGAGCCCAACCCGCGCCTCAACTTCTACCCGGTCTTCGCGGTGCCCGAGGCCCTGGCCACCTACCACCTCTTTTTCAAGAACC
AAAGGATCCCCGTCTCCTGCCGCGCCAACCGCACCCGCGCCGACGCCCTGCTCAACCTGGGCCCCGGCGCCCGCCTACCTGAT
ATCGCCTCCTTGGAAGAGGTTCCCAAGATCTTCGAGGGTCTGGGCAGCGACGAGACTCGGGCCGCGAACGCTCTGCAAGGAA
GCGGAGAGGAGCATGAGCACCACAGCGCCCTGGTGGAGTTGGAAGGCGACAACGCGCGCCTGGCGGTCCTCAAGCGCACGG
TCGAGCTGACCCACTTCGCCTACCCGGCGCTCAACCTGCCCCCCAAGGTCATGAGCGCCGTCATGGACCAGGTGCTCATCAAG
CGCGCCTCGCCCCTCTCGGAGGAGGAGATGCAGGACCCCGAGAGCTCGGACGAGGGCAAGCCCGTGGTCAGCGACGAGCAG
CTGGCGCGCTGGCTGGGAGCGAGTAGCACCCCCAGAGCCTGGAAGAGCGGCGCAAGCTCATGATGGCCGTGGTCCTGGTG
ACCGTGGAGCTGGAGTGTCTGCGCCGCTTCTTCGCCGACGCGGAGACCCTGCGCAAGGTCGAGGAGAACCTGCACTACCTCTT
CAGACACGGGTTCGTGCGCCAGGCCTGCAAGATCTCCAACGTGGAGCTGACCAACCTGGTCTCCTACATGGGCATCCTGCACG
AGAACCGCCTGGGGCAGAACGTGCTGCACACCACCCTGCGCGGGGAGGCCCGCCGCGACTACATCCGCGACTGCGTCTACCT
GTACCTCTGCCACACCTGGCAGACGGGCATGGGCGTGTGGCAGCAGTGCCTGGAGGAGCAGAACCTGAAAGAGCTCTGCAA
GCTCCTGCAGAAGAACCTCAAGGCCCTGTGGACCGGGTTCGACGAGCGCACCACCGCCGCGGACCTGGCCGACCTCATCTTCC
CCGAGCGCCTGCGGCTGACGCTGCGCAACGGGCTGCCCGACTTTATGAGCCAAAGCATGTTGCAAAACTTTCGCTCTTTCATCC
TCGAACGCTCCGGGATCCTGCCCGCCACCTGCTCCGCGCTGCCCTCGGACTTCGTGCCGCTGACCTTCCGCGAGTGCCCCCGC
CGCTCTGGAGCCACTGCTACCTGCTGCGCCTGGCCAACTACCTGGCCTACCACTCGGACGTGATCGAGGACGTCAGCGGCGAG
GGCCTGCTCGAGTGCCACTGCCGCTGCAACCTCTGCACGCCGCACCGCTCCCTGGCCTGCAACCCCCAGCTGCTGAGCGAGAC
CCAGATCATCGGCACCTTCGAGTTGCAAGGCCCCGGCGAGGGCAAGGGGGGTCTGAAACTCACCCCGGGGCTGTGGACCTCG
GCCTACTTGCGCAAGTTCGTGCCCGAGGACTACCATCCCTTCGAGATCAGGTTCTACGAGGACCAATCCCAGCCGCCCAAGGC
CGAGCTGTCGGCCTGCGTCATCACCCAGGGGGCCATCCTGGCCCAATTGCAAGCCATCCAGAAATCCCGCCAAGAATTTCTGC
TGAAAAAGGGCCACGGGGTCTACTTGGACCCCAGACCGGAGAGGAGCTCAACCCCAGCTTCCCCCAGGATGCCCCGAGGAA
GCAGCAAGAAGCTGAAAGTGGAGCTGCCGCCGCCGCCGGAGGATTTGGAGGAAGACTGGGAGAGCAGTCAGGCAGAGGAG
GAGGAGATGGAAGACTGGGACAGCACTCAGGCAGAGGAGGACAGCCTGCAAGACAGTCTGGAGGAGGAAGACGAGGTGG
AGGAGGCAGAGGAAGAAGCAGCCGCCGCCAGACCGTCGTCCTCGGCGGAGGAGGAGAAAGCAAGCAGCACGGATACCATC
TCCGCTCCGGGTCGGGGTCGCGGCGGCCGGGCCCACAGTAGATGGGACGAGACCGGGCGCTTCCCGAACCCCACCACCCAGA
CCGGTAAGAAGGAGCGGCAGGGATACAAGTCCTGGCGGGGGCACAAAAACGCCATCGTCTCCTGCTTGCAAGCCTGCGGGG
GCAACATCTCCTTCACCCGGCGCTACCTGCTCTTCCACCGCGGGGTGAACTTCCCCCGCAACATCTTGCATTACTACCGTCACCT
CCACAGCCCCTACTACTGTTTCCAAGAAGAGGCAGAAACCCAGCAGCAGCAGCAGCAGCAGAAAACCAGCGGCAGCAGCTAG
AAAATCCACAGCGGCGGCAGGTGGACTGAGGATCGCGGCGAACGAGCCGGCGCAGACCCGGGAGCTGAGGAACCGGATCTT
TCCCACCCTCTATGCCATCTTCCAGCAGAGTCGGGGGCAAGAGCAGGAACTGAAAGTCAAGAACCGTTCTCTGCGCTCGCTCA
CCCGCAGTTGTCTGTATCACAAGAGCGAAGACCAACTTCAGCGCACTCTCGAGGACGCCGAGGCTCTCTTCAACAAGTACTGC
GCGCTCACTCTTAAAGAGTAGCCCGCGCCCGCCCACACACGGAAAAAGGCGGGAATTACGTCACCACCTGCGCCCTTCGCCCG
ACCATCATCATGAGCAAAGAGATTCCCACGCCTTACATGTGGAGCTACCAGCCCCAGATGGGCCTGGCCGCCGGCGCCGCCCA
GGACTACTCCACCCGCATGAACTGGCTCAGTGCCGGGCCCGCGATGATCTCACGGGTGAATGACATCCGCGCCCACCGAAACC
AGATACTCCTAGAACAGTCAGCGATCACCGCCACGCCCCGCCATCACCTTAATCCGCGTAATTGGCCCGCCGCCCTGGTGTACC
AGGAAATTCCCCAGCCCACGACCGTACTACTTCCGCGAGACGCCCAGGCCGAAGTCCAGCTGACTAACTCAGGTGTCCAGCTG
GCCGGCGGCGCCGCCCTGTGTCGTCACCGCCCCGCTCAGGGTATAAAGCGGCTGGTGATCCGAGGCAGAGGCACACAGCTCA
ACGACGAGGTGGTGAGCTCTTCGCTGGGTCTGCGACCTGACGGAGTCTTCCAACTCGCCGGATCGGGGAGATCTTCCTTCACG
CCTCGTCAGGCCGTCCTGACTTTGGAGAGTTCGTCCTCGCAGCCCGCTCGGGTGGCATCGGCACTCTCCAGTTCGTGGAGGA
GTTCACTCCCTCGGTCTACTTCAACCCCTTCTCCGGCTCCCCGGCCACTACCCGGACGAGTTCATCCCGAACTTCGACGCCATC
AGCGAGTCGGTGGACGGCTACGATTGAATGTCCCATGGTGGCGCGGCTGACCTAGCTCGGCTTCGACACCTGGACCACTGCC
GCCGCTTCCGCTGCTTCGCTCGGGATCTCGCCGAGTTTGCCTACTTTGAGCTGCCCGAGGAGCACCCTCAGGGCCCGGCCCAC
GGAGTGCGGATCGTCGTCGAAGGGGTCTCGACTCCCACCTGCTTCGGATCTTCAGCCAGCGTCCGATCCTGGCCGAGCGCG
AGCAAGGACAGACCCTTCTGACCCTGTACTGCATCTGCAACCACCCCGGCCTGCATGAAAGTCTTTGTTGTCTGCTGTGTACTG
AGTATAATAAAGCTGAGATCAGCGACTACTCCGGACTTCCGTGTGTTCCTGCTATCAACCAGTCCCTGTTCTTCACCGGGAAC
GAGACCGAGCTCCAGCTCCAGTGTAAGCCCCACAAGAAGTACCTCACCTGGCTGTTCCAGGGCTCTCCGATCGCCGTTGTCAA
CCACTGCGACAACGACGGAGTCCTGCTGAGCGGCCCTGCCAACCTTACTTTTTCCACCCGCAGAAGCAAGCTCCAGCTCTTCCA
ACCCTTCCTCCCCGGGACCTATCAGTGCGTCTCGGGACCCTGCCATCACACCTTCCACCTGATCCCGAATACCACAGCGTCGCTC
CCCGCTACTAACAACCAAACTACCCACCAACGCCACCGTCGCGACCGCGGACATGTACAGAGCTCGAGAAGTACTAGGCCACA
ATACATGCCCATATTAGACTATGAGGCCGAGCCACAGCGACCCATGCTCCCCGCTATTAGTTACTTCAATCTAACCGGCGGAGA
TGACTGACCCACTGGCCAACAACAACGTCAACGACCTTCTCCTGGACATGGACGGCCGCGCCTCGGAGCAGCGACTCGCCCAA
CTTCGCATTCGCCAGCAGCAGGAGAGAGCCGTCAAGGAGCTGCAGGACGGCATAGCCATCCACCAGTGCAAGAAAGGCATCT
```

Fig. 27H

```
TCTGCCTGGTGAAACAGGCCAAGATCTCCTACGAGGTCACCCCGACCGACCATCGCCTCTCCTACGAGCTCCTGCAGCAGCGCC
AGAAGTTCACCTGCCTGGTCGGAGTCAACCCCATCGTCATCACCCAGCAGTCGGGCGATACCAAGGGGTGCATCCACTGCTCC
TGCGACTCCCCGACTGCGTCCACACTCTGATCAAGACCCTCTGCGGCCTCCGCGACCTCCTCCCCATGAACTAATCACCCCCTT
ATCCAGTGAAATAAATATCATATTGATGATGATTTAAATAAAAAATAATCATTTGATTTGAAATAAAGATACAATCATATTGATG
ATTTGAGTTTTAAAAAATAAAGAATCACTTACTTGAAATCTGATACCAGGTCTCTGTCCATGTTTTCTGCCAACACCACCTCACTC
CCCTCTTCCCAGCTCTGGTACTGCAGACCCCGGCGGGCTGCAAACTTCCTCCACACGCTGAAGGGGATGTCAAATTCCTCCTGT
CCCTCAATCTTCATTTTATCTTCTATCAGATGTCCAAAAAGCGCGTCCGGGTGGATGATGACTTCGACCCCGTCTACCCCTACGA
TGCAGACAACGCACCGACCGTGCCCTTCATCAACCCCCCCTTCGTCTCTTCAGATGGATTCCAAGAGAAGCCCCTGGGGGTGCT
GTCCCTGCGACTGGCTGACCCCGTCACCACCAAGAACGGGGAAATCACCCTCAAGCTGGGAGAGGGGGTGGACCTCGACTCC
TCGGGAAAACTCATCTCCAACACGGCCACCAAGGCCGCCGCCCCTCTCAGTTTTTCCAACAACACCATTTCCCTTAACATGGATA
CCCCTCTTTATACCAAAGATGGAAAATTATCCTTACAAGTTTCTCCACCGTTAAACATATTAAAATCAACCATTCTGAACACATTA
GCTGTAGCTTATGGATCAGGTTTAGGACTGAGTGGTGGCACTGCTCTTGCAGTACAGTTGGCCTCTCCACTCACTTTTGATGAA
AAAGGAAATATTAAAATTAACCTAGCCAGTGGTCCATTAACAGTTGATGCAAGTCGACTTAGTATCAACTGCAAAAGAGGGGT
CACTGTCACTACCTCAGGAGATGCAATTGAAAGCAACATAAGCTGGCCTAAAGGTATAAGATTTGAAGGTAATGGCATAGCTG
CAAACATTGGCAGAGGATTGGAATTTGGAACCACTAGTACAGAGACTGATGTCACAGATGCATACCCAATTCAAGTTAAATTG
GGTACTGGCCTTACCTTTGACAGTACAGGCGCCATTGTTGCTTGGAACAAAGAGGATGATAAACTTACATTATGGACCACAGC
CGACCCCTCGCCAAATTGCAAAATATACTCTGAAAAAGATGCCAAACTCACACTTTGCTTGACAAAGTGTGGAAGTCAAATTCT
GGGTACTGTGACTGTATTGGCAGTGAATAATGGAAGTCTCAACCCAATCACAAACACAGTAAGCACTGCACTCGTCTCCCTCAA
GTTTGATGCAAGTGGAGTTTTGCTAAGCAGCTCCACATTAGACAAAGAATATTGGAACTTCAGAAAGGGAGATGTTACACCTG
CTGAGCCCTATACTAATGCTATAGGTTTTATGCCTAACATAAAGGCCTATCCTAAAAACACATCTGCAGCTTCAAAAAGCCATAT
TGTCAGTCAAGTTTATCTCAATGGGGATGAGGCCAAACCACTGATGCTGATTATTACTTTTAATGAAACTGAGGATGCAACTTG
CACCTACAGTATCACTTTTCAATGGAAATGGGATAGTACTAAGTACACAGGTGAAACACTTGCTACCAGCTCCTTCACCTTCTCC
TACATCGCCCAAGAATGAACACTGTATCCCACCCTGCATGCCAACCCTTCCCACCCCACTCTGTCTATGGAAAAAACTCTGAAGC
ACAAAATAAAATAAAGTTCAAGTGTTTTATTGATTCAACAGTTTTACAGGATTCGAGCAGTTATTTTTCCTCCACCCTCCCAGGA
CATGGAATACACCACCCTCTCCCCCCGCACAGCCTTGAACATCTGAATGCCATTGGTGATGGACATGCTTTTGGTCTCCACGTTC
CACACAGTTTCAGAGCGAGCCAGTCTCGGGTCGGTCAGGGAGATGAAACCCTCCGGGCACTCCCGCATCTGCACCTCACAGCT
CAACAGCTGAGGATTGTCCTCGGTGGTCGGGATCACGGTTATCTGGAAGAAGCAGAAGAGCGGCGGTGGGAATCATAGTCC
GCGAACGGGATCGGCCGGTGGTGTCGCATCAGGCCCCGCAGCAGTCGCTGCCGCCGCCTCCGTCAAGCTGCTGCTCAGGG
GGTCCGGGTCCAGGGACTCCCTCAGCATGATGCCCACGGCCCTCAGCATCAGTCGTCTGGTCGGCGGGCGCAGCAGCGCAT
GCGGATCTCGCTCAGGTCGCTGCAGTACGTGCAACACAGGACCACCAGGTTGTTCAACAGTCCATAGTTCAACACGCTCCAGC
CGAAACTCATCGCGGGAAGGATGCTACCCACGTGGCCGTCGTACCAGATCCTCAGGTAAATCAAGTGGCGCTCCCTCCAGAAC
ACGCTGCCCACGTACATGATCTCCTTGGGCATGTGGCGGTTCACCACCTCCCGGTACCACATCACCCTCTGGTTGAACATGCAG
CCCCGGATGATCCTGCGGAACCACAGGGCCAGCACCGCCCCGCCCGCCATGCAGCGAAGAGACCCCGGGTCCCGGCAATGGC
AATGGAGGACCCACCGCTCGTACCCGTGGATCATCTGGGAGCTGAACAAGTCTATGTTGGCACAGCACAGGCATATGCTCATG
CATCTCTTCAGCACTCTCAGCTCCTCGGGGGTCAAAACCATATCCCAGGGCACGGGGAACTCTTGCAGGACAGCGAACCCCGC
AGAACAGGGCAATCCTCGCACATAACTTACATTGTGCATGGACAGGGTATCGCAATCAGGCAGCACGGGTGATCCTCCACCA
GAGAAGCGCGGGTCTCGGTCTCCTCACAGCGTGGTAAGGGGCCGGCCGATACGGGTGATGGCGGGACGCGGCTGATCGTG
TTCGCGACCGTGTCATGATGCAGTTGCTTTCGGACATTTTCGTACTTGCTGTAGCAGAACCTGGTCCGGGCGCTGCACACCGAT
CGCCGGCGGCGGTCCCGGCGCTTGGAACGCTCGGTGTTGAAATTGTAAAACAGCCACTCTCTCAGACCGTGCAGCAGATCTAG
GGCCTCAGGAGTGATGAAGATCCCATCATGCCTGATAGCTCTGATCACATCGACCACCGTGGAATGGGCCAGACCCAGCCAGA
TGATGCAATTTTGTTGGGTTTCGGTGACGGCGGGGAGGGAAGAACAGGAAGAACCATGATTAACTTTTAATCCAAACGGTC
TCGGAGCACTTCAAAATGAAGGTCGCGGAGATGGCACCTCTCGCCCCGCTGTGTTGGTGGAAAATAACAGCCAGGTCAAAG
GTGATACGGTTCTCGAGATGTTCCACGGTGGCTTCCAGCAAAGCCTCCACGCGCACATCCAGAAACAAGACAATAGCGAAAGC
GGGAGGGTTCTCTAATTCCTCAATCATCATTGTTACACTCCTGCACCATCCCCAGATAATTTTCATTTTTCCAGCCTTGAATGATTC
GAACTAGTTCCTGAGGTAAATCCAAGCCAGCCATGATAAAGAGCCTCGCGCAGAGCGCCCTCCACCGGCATTCTTAAGCACACC
CTCATAATTCCAAGATATTCTGCTCCTGGTTCACCTGCAGCAGATTGACAAGCGGAATATCAAAATCTCTGCCGCGATCCCTAA
GCTCCTCCCTCAGCAATAACTGTAAGTACTCTTTCATATCCTCTCCGAAATTTTTAGCCATAGGACCACCAGGAATAAGATTAGG
GCAAGCCACAGTACAGATAAACCGAAGTCCTCCCCAGTGAGCATTGCCAAATGCAAGACTGCTATAAGCATGCTGGCTAGACC
CGGTGATATCTTCCAGATAACTGGACAGAAAATCACCCAGGCAATTTTTAAGAAAATCAACAAAAGAAAAATCCTCCAGGTGC
ACGTTTAGAGCCTCGGGAACAACGATGAAGTAAATGCAAGCGGTGCGTTCCAGCATGGTTAGTTAGCTGATCTGTAAAAAACA
AAAAATAAAACATTAAACCATGCTAGCCTGGCGAACAGGTGGGTAAATCGTTCTCTCCAGCACCAGGCAGGCCACGGGGTCTC
CGGCGCGACCCTCGTAAAAATTGTCGCTATGATTGAAAACCATCACAGAGAGACGTTCCCGGTGGCCGGCGTGAATGATTCGA
CAAGATGAATACACCCCGGAACATTGGCGTCCGCGAGTGAAAAAAAGCGCCCGAGGAAGCAATAAGGCACTACAATGCTCA
GTCTCAAGTCCAGCAAAGCGATGCCATGCGGATGAAGCACAAAATCCTCAGGTGCGTACAAAATGTAATTACTCCCCTCCTGC
ACAGGCAGCGAAGCCCCCGATCCCTCCAGATACACATACAAAGCCTCAGCGTCCATAGCTTACCGAGCAGCAGCACACAACAG
GCGCAAGAGTCAGAGAAAGGCTGAGCTCTAACCTGTCCACCCGCTCTCTGCTCAATATATAGCCCAGATCTACACTGACGTAA
AGGCCAAAGTCTAAAAATACCCGCCAAATAATCACACACGCCCAGCACACGCCCAGAAACCGGTGACACACTCAAAAAAATAC
GCGCACTTCCTCAAACGCCCAAACTGCCGTCATTTCCGGGTTCCCACGCTACGTCATCGGAATTCGACTTTCAAATTCCGTCGAC
CGTTAAAAACGTCACCCGCCCCGCCCCTAACGGTCGCCCGTCTCTCGGCCAATCACCTTCCTCCCTCCCCAAATTCAAACAGCTC
ATTTGCATATTAACGCGCACCAAAAGTTTGAGGTATATTATTGATGATG
```

Fig. 27I

AdC7 010-DU422gp160(E1623) Amino acids – SEQ ID NO: 16
The symbol " * " refers herein to stop codons in the non coding regions HHQ*YTSNFWCALICK*AV*IWGGRKVIGRETGDR*GRGG*RFDDVAVRRSRFASSRGKSDVKRGVV*TRKYSIFPRSLTGNEVFLG
GCK*KRAIFARKLNEEVKI*VISRLWQGGVFAEGRVDFDRLRGGFDYRIFHLNFRVRCQSPVFLRTISFPRKCHLTVTITVLR*RKLRSP
DPLWCTLSTICSDAA*LSQYLLPACVLEVAE*CASKI*ATTRQGLTDNCMKNLLRVRRFALLRDVRARYTR*H*LLTSMPSTPPIDVND
GKWPAWHYAQYMTLWDFPTWQYIYVLVIAITMVMRFWQYINGRG*RFDSRGFPSLHPIDVNGSLFWHQNQRDFPKCRNNSAP
LTQMGGRRVRWEVYISRARLVNRQITRSFIAVVYHS*IANAVSASDTTVSNLRLEFDATMRVRGIPRNWPQWWIWGILGFWMIIIC
RVVGNLDLWVTVYYGVPVWKEAKTTLFCASDAKAYDKEVHNVWATHACVPTDPNPQEIVLENVTENFNMWKNDMVDQMHED
IISLWDQSLKPCVKLTPLCVTLNCKNVNISANANATATLNSSMNGEIKNCSFNTTTELRDKKQKVYALFYKPDVVPLNGGEHNETGEY
ILINCNSSTITQACPKVSFDPIPIHYCAPAGYAILKCNNKTFNGTGPCNNVSTVQCTHGIKPVVSTQLLLNGSLAEEEIIVRSENLTNNIKT
IIVHLNKSVEIKCTRPNNNTRKSVRIGPGQTFYATGEIIGDIREAHCNISRETWNSTLIQVKEKLREHYNKTIKFEPSSGGDLEVTTHSFN
CRGEFFYCDTTKLFNETKLFNESEYVDNKTIILPCRIKQIINMWQEVGRAMYAPPIEGNITCKSNITGLLLTWDGGENSTEGVFRPGG
GNMKDNWRSELYKYKVVEIKPLGVAPTKSKRKVVGREKRAVGLGAVLLGFLGAAGSTMGAASITLTVQARQLLSGIVQQQSNLLRA
IEAQQHLLQLTVWGIKQLQTRVLAIERYLKDQQLLGLWGCSGKLICATAVPWNSSWSNKSLGDIWDNMTWMQWDREISNYTNTI
FRLLEDSQNQQEKNEKDLLALDSWKNLWNWFDITNWLWYIKIFIMIVGGLIGLRIIFGVLAIVKRVRQGYSPLSFQTLIPNPRGPDRL
GRIEEEGGEQDKDRSIRLVSGFLALAWDDLRSLCLFSYHQLRDFILTAARAAELLGRSSLRGLQRGWEVLKYLGNLVQYWGLELKRSAI
NLFDTIAIAVAEGTDRIIEVIQRICRAIRYIPTRIRQGFEAALL*GTSRVDPGGQTADQPRLCLLVASHLLFAPPPCLP*PWKVPLPLSFPN
KMRKLHRIV*VGVILFWGVGWGRTARGRIGKTIAGMLGMRWALWLLRRKEPADLQI*IHLCRVRRKRNGIMGIMGLHIGQI
SICWPPCM*PRTPARHGPSSSTTS*PDAMCTWGPAEACSCPTSATCNL*RCCWSPMPCPE*A*RGCLT*MWSCGKF*DMMNPR
PGAGPANAEASTPGFSPCVWR*RRTCDPIIWCCPATGRSSAPAGKNLTRVSSVWGRWRACMRGRMTKICVFLCVAAA*AEAPPL
REGYSALI*RGVSPPGRECVRM*WDPRWTAGPCSPRTLQP*PTRP*APRPWTQLPPQLLLPPPAPCAEWPWAPATTALWWPTRL
PPIIPPA*TRRSCCC*WPSSRP*PSAWAS*PSRWLSCRRRRGPRLPR*KPNKK*INK*TETVVDFNTES*IFI*FFARGRPWTTGLDH*
APGGFFPGPGRGGLGC*GTWA*ARPGGGGSSIAGPRARGWCCKSPSHSRGAGRGAARCP*GGD*WPRAAPWCRC*RTC*AGR
DACGGR*DASWPGS*DWRCSRPDPAGGSCCAGPPARCIRRTWGICHATWKGRRERIWRRPCDRPGFPCTHP**WRWARGRRP
GQRRFGGRTHRSCGPG*ARHRPF**IWGGGCPTGGRRCPRSRGRSCPRRSASPRP*ARRGGSCPPAGR*KKRFPGRGR*AGPKAG
SGAAGTCRSRWGRR*PR*PAAGGS*GRDSCRPRGGGGPPRSSSRAHACSRARVPPGGARPPARGALAARRSFSAA*XRRPWAF
WRGSVARVPDGPRAR*CALGHLDPADLLVSRVGATAGVGHQAMGVQRGQGPVLPGSQGPRQRGLRHGEGVRAGLGACEGAL
QAHPAGREPLPVGALRVGQVAIEHEFVVERLGRVALGAELTFGSVSADGTEEGLEGVELGGEEDGLGGVGVRAAAGADGLALHEP
GEVGPVGVKNEVSSVLFDAFLTSGLHELVSPLGDKEAVRVPVDRLYGPVLERGAAVLVVEEPRPLRDEGPGPGQHEGGHVGGVAV
VVHQRVHLLQGMQAHVPLVHIQEGDWLVSVGHVTGGPGRGGIKGGGPLLVLTVFRIAVQERQLLG*VFPLEGWHNLGTQVVSF*
KRGGFDIDGAVGDAFHEPLVHLVRKDDLFVVELGGEGAVEGVGEELGDGAHGLVLFLVGALLGGDVELHVLARHALPFGEDGGELV
GHDSDPPAAVVQGDEVHAGGHLAAQGLVGPAEAPALARAEGGQRVQHELVGGVGVHGEDAGQKLGVEVADAGVQIVQRRLPV
AHGQRALVGAEGRAPGHGVRERGGVHAADVVDVEGLLEDADVGGVAAPPADAGAHVVQLVRGREEPRAEVGALRLFGAVDD
LAEDGVGVGGDGGPLEDVEVGVGQADRVPDEVGVGVLQLGDELGGDEDVQGAVVEGLLDDVVLELALLLPQLAVEKELFAVLPVL
FEGEPVLIGTVRAHHVELVDGLVGAAALLHGEGVSLCGLAQGGVGEGEGVAHHDLEELVLEVEVVAAALLPELEVRALLVGGVGQS
ESNIVEEDLARAGHEVASDAERLGHLGPVVDDLGGEDDLVEAVDVVPDDVEFHESRAALNVGQLLELVVGELGGVAEPVLLEGPVG
DVGVGAEEGSPEIHGQGGLQAVPVLTELLAHGHFFGGDAVEGAGVAVPAVPLELEGEVVGELDERRVPGEFHDQHEGDELLAEGP
HPGVGFHIVGEEEPFGARMRADGEELDLLPPVGGMAVDVMEVEMPTARRLVLVLVFIQASAVLATLHGMHVLHELYLGSFDEEFQ
WAVERWRLHLVLYYVLAIGVAIVCLDGGHADEPAREAGPDFGSDGSESEDEGAQAGAVQGPETLRSQVSGQRRRAVDLQELFQG
AREVQMVLDLHGAVGGDVHGLQGPVPLGRHHRAPFLLGRCFHAGQKRRRGRAPGGRGGSGPGGRGGRGTSAPRAGRFWYCAR
RRLA*ATTRRLTSWI*RLWVKATGPVSLNLKESSTESISVSLTAACRRISCTSPELSW*AISVMNCSISSS*RSPRPARSTVAARSLEMR
PMSCEKAFMPASFQTRL*TTAPSGSRARMTTWARLSSTWRVKTA*LQRRW*R*LSVVAMCSVTKKYMIQRRSGISLTSPRASKRS
MAS*KSTAKLKNWELRAETVNSSSRRRMSSAMVARTSRSKAPGGSSSSISSSTNISSTSSSGGGGGGALRRRRRTGRRSMKRSM
VSPRRRRMVSVTARPSSRGRSVKTPPRISRWPPGGSPLGRERALTMHLINWPVGTPRKDLSVSRSTGSENR*TKASSQSQSQGRLS
PVSCSSGISGGGRAMLLVMKLK*AVLRRRMVARSTRSLGPACWMRRRSAMPQAWS*HLARSL**SCMSRSTGTSSSPARPCMRV
SPNPRWGWTSARSATTRSARMACCIWVRVVWKSSKSTKRW*APVLMV*EQLAMTDQLTVWWPGRTSSWYLRRE*ARVSKM*
SLQVRTRYWYPTRKCGGGWR*SGHRSVAGAPGARSSSMRRW*P*MYLDIQVMPAAVVEARGNSRTRFQMLRSGRK*FMVAAV
WPVRRAQSWML*TYGQKRKRSAARLRGLEAKRTGWAARVPRFESRIRLEPQLTWYWHSRLDPSLLTKPPGYGGGSFFGLGRWS*
KTSKRGKRPPAMARCRSLEKESPGLRCGVPRFEPQRSAPAGFRG*RGRGCPVVSKTP*PADFSSYGASPSFSCVFARCIPYCGRCAPT
LHLNRPYRRSSSNSRRFCPRPSSSQPLPRRPP*AEPAFSMTWPWKRARGWRGWGRRRRSGTRACR*KGTLARPTCPSRTCSETGA

Fig. 27J

ARSPRRCAPPASTRGGSCGAAWTESGC*GTRISRRTS*RGSAPRARTWPRPTWSRRTSRP*RRRATSKNPSTTTCAR*SRARR*PW
A*CTCGTCWRPSCRTPRASR*RRSCFWWCSTVGTTRRSGRRC*ISPSPRAAGSWTW*TFCRASWCRSAGCRCPRSWRLSTSRC*A
WASTTLGRSTRPRTCP*TRR*RSTGFTCA*P*KC*P*ATIWGCTATTGCTAR*APAAGAS*ATRS*CTACSGP*PGPGPRGRATLTW
ARTCAGSPAAGPWKLPAVPPTWRRWTMRRRRASTWKTDGATVFLLDAATATAS*SRDAGGAAEPAVRH*LLGRLDPGHATHHG
ADDPQSRSL*TAASGQPALGHPGGRGALALEPHAREGAGHRERAGGEQGHPRRRGRAGVQRAAGARGPLQQHQRADEPGPHG
DRRARGGVAARAVPPRVEPGLHGGAERLPEHAARQRAPGPGGLHQLHQRAAADGGRGAPERGVPVGAGLLLPDQSPGLADREP
EPGFQELAGTVGRAGPGRGPRDGVEPADAELAPAAAAGGALHGQRQREPRLVPGLPA*PVPRGHRAGARGRADLPGDHPREPR
AGPGGPGQPGGHPELPADQPVAEDPAPVRAEHRGGAHPALRAAERGAVPDAGGGHAQRRARHDRAQHGAQHVRSQPPVHQ*
ADGLLASGGRHELGLLYQRHLEPALAPAARVLHGRVRHARPQRRVPVGRRGQQRVLAAPRHHRVEERGRGPAAVLGAVRSRGCC
RGGA*GRQPLPEPALFAEQRAQQRAGSADAAAPAGRGGVPERLLVEARAREELPQ*RDREPGGQDEPLEDVRARAQGRAPS*QQ
RRHP*TPATRQAAGSGVGR*GFRRRQQRVGLGWEWWW*PVRSLAPPYRAPDVRI*KNKKRYSPRPWRPACVLLCCL**YDEARV
PGGSSSLVRERDAAGGGGGDAAPAGGALRAPAVPGAYGGAEQHSLLGAGTLVRYHPVVPGGQQVGGHRLAELPERPQQLPDHR
GAEQRFHPGGQHPDHQL*RALAVGRPAENHHAHQHAQRERVHVQQQVQGAGDGLAQDPQWGRGG*EL*W*SGRADLRV
GGV*AARGQLLGDHDHRSDEQRHHRQLLGGGASERGAGERHRREVRHAQLPAGLGPRDRAGDAGRVHQRGLPPRHRPAARLR
RGLHREPPQQPAGHPQAAALPGGLPDPVRGPGGGQHPRALGCRSL*EKQGGGRRSGDRSRGHRLYRGAGR*FC*RRGSGRGG*
NRK*DSHPAGGEGQQGQELQRARGQEKHRLPQLVPGLQLRRPREGRALLDAAHHLGRHLRRGASLLVAARHDARPGHLPLHASS
*QLPGGGRRAPARLLQELLQRAGRLLAAAARLHLAHARLQPLPREPDPRPPARAHHYHRQ*KRSCSHRSRDPAAAQQYPGSPARD
RH*RQTPHLPLRLQGPGRSRAARPLEPHLLKNVHSHLAQ**HRLGPARAQQDVRRRSPTLHATPRARARALPRSLGRPQGPRALAH
HRRRRDRPGGGRRAQLHARRRARLHRGRRHRQRGGRCAPVRPRQEPAAAHRPAAPEHPRHARGASLAAQGQAHGTQGHAQG
GQTRGLRQQQRRQDPQTRGHGGGGGHRQHVPPAARQRVLGARRRHRCARARAHPPPSHLKMLTSRC*CVPAARRMSKRKYKE
EMLQVIAPEIYGPAVKEERKPRKLKRVKKDKKEEEDVDGLVEFVREFAPRRRVQWRGRKVKPVLRPGTTVVFTPGERSGSASKRSYD
EVYGDEDILEQAVERLGEFAYGKRSRPAPLKEEAVSIPLDHGNPTPSLKPVTLQQVLPSAAPRRGFKREGGEDLYPTMQLMVPKRQK
LEDVLEHMKVDPEVQPEVKVRPIKQVAPGLGVQTVDIKIPTEPMETQTEPVKPSTSTMEVQTDPWMPAPASTTRRRRKYGAASLL
MPNYALHPSIIPTPGYRGTRFYRGYTSSRRKTTTRRRRRRTRRSSTATSAAALVRRVYRSGREPLTLPRARYHPSIAI*LCRRLLLADMA
LTCRLRVPITGYRGRKPRRRRLTGNGLRRHHHRRRRAISKRLGGGFLPALIPIIAAAIGAIPGIASVAVQASQRH*DTAWKICNKKMD*
RSWSCDVCF*MEDINFSSLAPRHGTRPFMGTWSDIGNSQLNGGAFNWSSLWSGLKNFGSTLKTYGNKAWNSSTGQALREKLKEQ
NFQQKVVDGLASGINGVVDLANQAVQKQINSRLDAVPPAGSVEMPQVEEELPPLDKRGDKRPRPDAEETLLTHTDEPPPYEEAVKL
GLPTTRPVAPLATGVLKPSSSSQPATLDLPPPASRPSTVAKPLPPVAVASRAPRGRPQANWQSTLNSIVGLGVQSVKRRRCY*KTL*R
LTCLSVCICMSADQKEEEARRRVARWPPHRCCPSGRTCTSPDRTLRST*VRVWCSSPAPQTPTSVWGTSLGTPRWRPRTM*PPTA
ASG*RCASCPWTARTTPTRTKCATRWPWATTACWTWPAPTLTSAACWIGGPASNPTPAPPTTAWLPRERPTLASGHIKLVILIQKK
PIHMEMHLCKALALQRMVFNLELTAMVRQSMQTKLINQSLKWVMLNGMTSLVLMKNMEAELLSLTPK*SLAMVLLPSLPIKKEAR
QM*KPKQAVPKNMTLTWHSSIIEVQLPPA*PQKLFCILRMWIWKLQIPILYTRQVQMTVALLSIWVSSPCPTDPTTLASETTLSV*CT
TTALAIWVYWLDRPPS*MLWWTCRTETPNCPTSSCLTLWVTEPGISVCGIRRWTVMTPMCALLKITVWRMNFLTIASPWMLWVE
LILTRELRPMVIIKPPGPKMILLMMLMNWARAILSPWRSTSRPTCGGTSSTRTWRCTCPTPTSTRRPTSRCPPTPTPTIT*TAAWWR
PRWWTPTSTSGRAGRWTPWTTSTPSTTTATRACDTAPCSWATGATCPSTSRCPKSFSPSRASCSCPGPTPTSGTSARTST*SCRAPS
ATTCARTGPPSPSPASTSTPPSSPWRTTPPPRSRPCCATTPTTSPSTTTSRRPTCSTPSRPTPPTCPSPSPRATGPPSAAGPSRASRPAR
RPRSAPGSTPTSSTRAPSPTSTAPSTSTTPSRRSPSPSTPPSAGPATTAS*RPTSSKSSAPSTERGTTWPSAT*PRTGSWSRCWPTTTS
ATRASTCPRATRTACTPSSATSSP*AARSWTRSTTRTTRPSPWPTSTTTRASSATSRPPCARASPTPPTTPTRSSARAPSPASPRKSSS
ATGSCGASPSPATSCPWARSPTSARTCSTPTPPTR*T*ISKSTPWMSPPFSMLSSKSSTSSECTSPTAASSRPSTCARPSRPATPPPKPL
ASCKMTACAGSGEQELRAILRDLGCGPCFLGTFDKRFPGFMAPHKLACAIVNTAGRETGGEHWLAFAWNPRSHTCYLFDPFGFSD
ERLKQIYQFEYEGLLRRSALATEDRCVTLEKSTQTVQGPRSAACGLFCCMFLHAFVHWPDRPMDKNPTMNLLTGVPNGMLQSPQV
EPTLRRNQEALYRFLNAHSAYFRSHRARIEKATAFDRMNQDM*SGVCM*MLYSS**TAHVYATFSEALTLFRNRRGSAGSRHGPRA
GIRCGTGTWAAT*TRGSAASARGGRGTSRSTACA*VAGRPAGRARRS*NRSWDPRSARESYGTRGCSTGTPSGPGASRSPAPSRR
*CPPRPDPRRWPSRRGSSCRSAAPCWARSRACGCNRSAGGSASSGPARSSCPGTWPS*KPPAGGRPAAPCRPR*RRPRRTC*RTG
WWRSQRRARSSARRCWPAAPRCAPSGSG*SWPGRGSPSARAARSRSPHPSRSCAPSGSSRSRAGTAACPRPRCTRAATARSRCSP
SSCGRSGSASARSPAGSGPSSWSGSCCW*RSAECRGAPRSHTGGRYGGTPRPARASAGRRTSGRSPRGTGPSAASSLPCPSPRPKR
SAGSGGSSPLSS*SPPPKSGGRSRPGSQTLACRPSR*CARGES*SPRPPAPPRPAFRPRCPG*CLAKAHAWSCGVSFWAAEAAAETC
WASASSRSPRLFLLLGRRPRPRGGRHASSGAEAEATGSRGSAGGWQSPFRVRGCAPGGAALTDFLRGRPLCSPREQAWRLSHRRQ
HRHLPPPPPTRTSSSRMKA*PPRRPAPPPTPQPQTCKRWRNPSRLTWAT*RPRSTRRSWQRAFQPRKRTTKSSQSRKQRASRTRL
GSSMATT*AGQRTCSSSIWPANASSSRTRCSTAPRCPSAWRSSAAPTSATSSRRACPPSASPTAPASPTRASTSTRSSRCPRPWPPTT
SFSRTKGSPSPAAPTAPAPTPCSTWAPAPAYLISPPWKRFPRSSRVWAATRLGPRTLCKEAERSMSTTAPWWSWKATTRAWRSSS

Fig. 27K

ARSS*PTSPTRRSTCPPRS*APSWTRCSSSAPRPSRRRRCRTPRARTRASPWSATSSWRAGWERVAPPRAWKSGASS*WPWSW*
PWSWSVCAASSPTRRPCARSRRTCTTSSDTGSCARPARSPTWS*PTWSPTWASCTRTAWGRTCCTPPCAGRPAATTSATASTCTS
ATPGRRAWACGSSAWRSRT*KSSASSCRRTSRPCGPGSTSAPPPRTWPTSSSPSACG*RCATGCPTL*AKACCKTFALSSSNAPGSC
PPPAPRCPRTSCR*PSASAPRRSGATATCCAWPTTWPTTRT*SRTSAARACSSATAAATSARRTAPWPATPSC*ARPRSSAPSSCKA
PARARGV*NSPRGCGPRPTCASSCPRTTIPSRSGSTRTNPSRPRPSCRPASSPRGPSWPNCKPSRNPAKNFC*KRATGSTWTPRPER
SSTPASPRMPRGSSKKLKVELPPPPEDLEEDWESSQAEEEEMEDWDSTQAEEDSLQDSLEEEDEVEEAEEEAAAARPSSSAEEEKAS
STDTISAPGRGRGGRAHSRWDETGRFPNPTTQTGKKERQGYKSWRGHKNAIVSCLQACGGNISFTRRYLLFHRGVNFPRNILHYYR
HLHSPYYCFQEEAETQQQQQQQKTSGSS*KIHSGGRWTEDRGERAGADPGAEEPDLSHPLCHLPAESGARAGTESQEPFSALAHP
QLSVSQERRPTSAHSRGRRGSLQQVLRAHS*RVARARPHTEKGGNYVTTCALRPTIIMSKEIPTPYMWSYQPQMGLAAGAAQDYS
TRMNWLSAGPAMISRVNDIRAHRNQILLEQSAITATPRHHLNPRNWPAALVYQEIPQPTTVLLPRDAQAEVQLTNSGVQLAGGAA
LCRHRPAQGIKRLVIRGRGTQLNDEVVSSSLGLRPDGVFQLAGSGRSSFTPRQAVLTLESSSSQPRSGGIGTLQFVEEFTPSVYFNPFS
GSPGHYPDEFIPNFDAISESVDGYD*MSHGGAADLARLRHLDHCRRFRCFARDLAEFAYFELPEEHPQGPAHGVRIVVEGGLDSHLL
RIFSQRPILAEREQGQTLLTLYCICNHPGLHESLCCLLCTEYNKS*DQRLLRTSVCSCYQPVPVLHRERDRAPAPV*APQEVPHLAVPG
LSDRRCQPLRQRRSPAERPCQPYFFHPQKQAPALPTLPPRDLSVRLGTLPSHLPPDPEYHSVAPRY*QPNYPPTPPSRPRTCTELEKY*
ATIHAHIRL*GRATATHAPRY*LLQSNRRR*LTHWPTTTSTTFSWTWTAAPRSSDSPNFAFASSRREPSRSCRTA*PSTSARKASSAW
*NRPRSPTRSPRPTIASPTSSCSSARSSPAWSESTPSSSPSSRAIPRGASTAPATPPTASTL*SRPSAASATSSP*TNHPLIQ*NKYHIDD
DLNKK*SFDLK*RYNHIDDLSFKK*RITYLKSDTRSLSMFSANTTSLPSSQLWYCRPRRAANFLHTLKGMSNSSCPSIFILSSIRCPKSAS
GWMMTSTPSTPTMQTTHRPCPSSTPPSSLQMDSKRSPWGCCPCDWLTPSPPRTGKSPSSWERGWTSTPRENSSPTRPPRPPPLS
VFPTTPFPLTWIPLFIPKMENYPYKFLHR*TY*NQPF*TH*L*LMDQV*D*VVALLLQYSWPLHSLLMKKEILKLT*PVVH*QLMQVD
LVSTAKEGSLSLPQEMQLKAT*AGLKV*DLKVMA*LQTLAEDWNLEPLVQRLMSQMHTQFKLNWVLALPLTVQAPLLLGTKRMIN
LHYGPQPTPRQIAKYTLKKMPNSHFA*QSVEVKFWVL*LYWQ*IMEVSTQSQTQ*ALHSSPSSLMQVEFC*AAPH*TKNIGTSERE
MLHLLSPILML*VLCLT*RPILKTHLQLQKAILSVKFISMGMRPNH*C*LLLLMKLRMQLAPTVSLFNGNGIVLSTQVKHLLPAPSPSPT
SPKNEHCIPPCMPTLPTPLCLWKKL*STK*NKVQVFY*FNSFTGFEQLFFLHPPRTWNTPPSPPAQP*TSECHW*WTCFWSPRSTQ
FQSEPVSGRSGR*NPPGTPASAPHSSTAEDCPRWSGSRLSGRSRRAAVGIIVRERDRPVVSHQAPQQSLPPPLRQAAAQGVRVQGL
PQHDAHGPQHQSSGAAGAAAHADLAQVAAVRATQDHQVVQQSIVQHAPAETHRGKDATHVAVVPDPQVNQVALPPEHAAHV
HDLLGHVAVHHLPVPHHPLVEHAAPDDPAEPQGQHRPARHAAKRPRVPAMAMEDPPLVPVDHLGAEQVYVGTAQAYAHASLQ
HSQLLGGQNHIPGHGELLQDSEPRRTGQSSHITYIVHGQGIAIRQHRVILHQRSAGLGLLTAW*GGRPIRVMAGRG*SCSRPCHDA
VAFGHFRTCCSRTWSGRCTPIAGGGPGAWNARC*NCKTATLSDRAADLGPQERSHHAL*SHRPPWNGPDPAR*CNFVGFR
*RRGREEQEEP*LTFNPNGLGALQNEGRGDGTSRPRCVGGK*QPGQR*YGSRDVPRWLPAKPPRAHPETRQ*RKREGSLIPQSSC
YTPAPSPDNFHFSSLE*FELVPEVNPSQP**RARAERPPPAFLSTPS*FQDILLLVHLQQIDKRNIKISAAIPKLLPQQ*L*VLFHILSEIFS
HRTTRNKIRASHSTDKPKSSPVSIAKCKTAISMLARPGDIFQITGQKITQAIFKKINKRKILQVHV*SLGNNDEVNASGAFQHG*LADL*
KTKNKTLNHASLANRWVNRSLQHQAGHGVSGATLVKIVAMIENHHRETFPVAGVNDSTR*IHPRNIGVRE*KKAPEEAIRHYNAQS
QVQQSDAMRMKHKILRCVQNVITPLLHRQRSPRSLQIHIQSLSVHSLPSSSTQQAQESEKG*ALTCPPALCSIYSPDLH*RKGQSLKIP
AK*SHTPSTRPETGDTLKKIRALPQTPKLPSFPGSHATSSEFDFQIPSTVKNVTRPAPNGRPSLGQSPSSLPKFKQLICILTRTKSLRYIID
D

Manufacturing Flow Chart

* In the event the MVB is not large enough to provide sufficient material at the stipulated dose level required for preclinical and clinical studies, the virus from the MVB will undergo one round of further expansion and virus from this expansion is used for GMP production.

US 10,953,108 B2

COMPOSITIONS AND METHODS OF REPLICATION DEFICIENT ADENOVIRAL VECTORS FOR VACCINE APPLICATIONS

CROSS-REFERENCE TO RELATED APPLICATIONS

The present application is a 35 U.S.C. § 371 national phase application from, and claims priority to, International Application No. PCT/US2017/043315, filed Jul. 21, 2017, which claims priority under 35 U.S.C. § 119(e) to U.S. Provisional Application Ser. No. 62/369,288, filed Aug. 1, 2016, all of which applications are incorporated herein by reference in their entireties.

STATEMENT REGARDING FEDERALLY SPONSORED RESEARCH OR DEVELOPMENT

This invention was made with government support under grants P01 AI082282 and U19 AI074078, awarded by the National Institutes of Health. The government has certain rights in the invention.

BACKGROUND OF THE INVENTION

Vaccination is widely recognized as the most effective method of preventing or ameliorating morbidity from infectious diseases. However, traditional methods of vaccine development using inactivation or attenuation of viruses have failed for some of the most deadly human pathogens, necessitating new approaches. Progresses in research have enabled the genetic manipulation of viruses allowing their attenuation as well as incorporation of other foreign sequences. Viral vectors have been studied as potential tools to deliver vaccines as they present advantages over traditional vaccines in that they stimulate a broad range of immune responses including antibody (B cell), T helper cell-($CD4^+$ T cell), and cytotoxic T lymphocyte- (CTL, $CD8^+$ T cell) mediated immunity. These viral vector vaccines could be used against various infectious and malignant diseases (Small and Hildegund, Curr Opin Virol. 2011, Oct. 1; 1(4): 241-245).

Adenoviruses (Ad) vectors are commonly used as vaccine carriers because of their ability to induce insert-specific $CD8^+$ T cell responses, they have broad tropism, high transduction efficiency and relatively pose no to low risks. However, vaccination is less effective in the presence of neutralizing antibodies (nAb) and pre-existing Ad-specific immunity represents a major obstacle for Ad-based vaccines as it decreases gene transfer efficacy and increases vector-mediated toxicity Until now, most Ad vectors are based on human serotype 5 (AdHu5). This virus is endemic in most human populations, and neutralizing antibodies specific to AdHu5 can be detected in up to 40-90% of humans. Seroprevalence of other known human Ads also fluctuate globally with the occurrence of natural infection.

To avoid the potential limitations imposed by preexisting immunity, vectors based on rare human Ad serotypes and Ad from other species are being explored. For instance, vectors based on alternative Ad serotypes are in development, including AdHu26, 35, 48, and the chimpanzee-derived AdC6, C7, and C68. Neutralizing titers to these various rare Ad serotypes are typically low in humans, with seroprevalence to AdC6 and AdC7 less than 5% of adults in the United States and less than 10% seropositive in equatorial Africa, the natural habitat for chimpanzees. However clinical proof of safety, tolerability and immunogenicity of these alternates Ad vectors remain lacking. Certain Adenovirus vectors are disclosed in U.S. application Ser. No. 14/190,787.

Clearly, there is a need in the art for methods of producing more efficient adenovirus vector vaccine systems that circumvent the host's pre-existing immunity, support gene expression of large foreign inserts, while inducing a potent immune response and being stable and safe for the host. The present invention fulfills this need.

SUMMARY OF THE INVENTION

The invention provides a composition comprising a nucleic acid sequence of a chimpanzee-derived adenovirus vector of serotype AdC6 or AdC7, wherein the early gene E1 is deleted, the ORF3, ORF4, ORF5, ORF6, and ORF7 from the early gene E3 are deleted, and wherein the nucleic acid sequence further comprises a promoter sequence linked to a sequence encoding a heterologous protein, wherein the heterologous protein is at least one HIV protein selected from the group consisting of gp140, gp160 and Gag.

In one embodiment, the promoter is a constitutive promoter. In another embodiment, the promoter is a cytomegalovirus immediate early promoter (CMV). In yet another embodiment, the nucleic acid sequence is selected from the group consisting of SEQ ID NOs: 1-8.

In another aspect, the invention provides a protein expression system comprising the composition listed above herein which comprises a nucleic acid sequence of a chimpanzee-derived adenovirus vector of serotype AdC6 or AdC7, wherein the early gene E1 is deleted, the ORF3, ORF4, ORF5, ORF6, and ORF7 from the early gene E3 are deleted, wherein the nucleic acid sequence further comprises a promoter sequence linked to a sequence encoding a heterologous protein, wherein the heterologous protein is at least one HIV protein selected from the group consisting of gp140, gp160 and Gag, and further wherein the nucleic acid sequence is selected from the group consisting of SEQ ID NOs: 1-8.

The invention also provides a protein expression system comprising the composition listed above herein which comprises a nucleic acid sequence of a chimpanzee-derived adenovirus vector of serotype AdC6 or AdC7, wherein the early gene E1 is deleted, the ORF3, ORF4, ORF5, ORF6, and ORF7 from the early gene E3 are deleted, wherein the nucleic acid sequence further comprises a promoter sequence linked to a sequence encoding a heterologous protein, wherein the heterologous protein is at least one HIV protein selected from the group consisting of gp140, gp160 and Gag, and further wherein the nucleic acid sequence encodes an amino acid sequence selected from the group consisting of SEQ ID NOs: 9-16.

The invention further provides a method of eliciting an immune response in a mammal against a heterologous protein. The method of the invention comprises administering to the mammal a composition comprising a nucleic acid sequence of a chimpanzee-derived adenovirus vector of serotype AdC6 or AdC7, wherein the early gene E1 is deleted, the ORF3, ORF4, ORF5, ORF6, and ORF7 from the early gene E3 are deleted, and wherein the nucleic acid sequence further comprises a promoter sequence linked to a sequence encoding a heterologous protein, wherein the heterologous protein is at least one HIV protein selected from the group consisting of gp140, gp160 and Gag.

In one embodiment, the nucleic acid sequence is selected from the group consisting of SEQ ID NOs: 1-8.

In another aspect, the invention provides a method of treating and/or preventing HIV in a mammal. The method of the invention comprises administering a therapeutically effective amount of a composition encoded by a nucleic acid sequence selected from the group consisting of SEQ ID NOs: 1-8.

In yet another aspect, the invention provides method of vaccinating a mammal against HIV infection. The method of the invention comprises administering to the mammal a pharmaceutically acceptable amount of the composition listed above herein, which comprises a nucleic acid sequence of a chimpanzee-derived adenovirus vector of serotype AdC6 or AdC7, wherein the early gene E1 is deleted, the ORF3, ORF4, ORF5, ORF6, and ORF7 from the early gene E3 are deleted, wherein the nucleic acid sequence further comprises a promoter sequence linked to a sequence encoding a heterologous protein, wherein the heterologous protein is at least one HIV protein selected from the group consisting of gp140, gp160 and Gag, and further wherein administration of the composition elicits an immune response in the mammal.

In one embodiment, the composition is administered prophylactically to the mammal. In another embodiment, the composition is administered therapeutically to the mammal. In yet another embodiment, composition is administered in combination with an adjuvant.

In a further aspect, the invention includes a method of generating a effector and memory T cell immune response to a heterologous protein in a mammal. The method of the invention comprises the steps of: (a) administering the composition of the invention listed above herein to a mammal in an amount effective to elicit an immune response in the mammal; (b) administering a second effective amount of the chimpanzee-derived adenovirus vector of the composition of the invention listed above herein at a second, subsequent time period, wherein T memory cells directed against the heterologous protein are reactivated in the mammal.

In one embodiment, the composition administered first in (a) and second in (b) comprises a same or a different HIV heterologous protein selected from the group consisting of gp140, gp160 and Gag. In another embodiment, the composition administered first in (a) and in (b) has a same or a different serotype selected from the group consisting of AdC6 and AdC7.

In yet a further aspect, the invention includes a method of generating an adaptive B cell immune response to a heterologous protein in a mammal. The method of the invention comprises the steps of: (a) administering the composition of the invention listed above herein to a mammal in an amount effective to elicit an immune response in the mammal; (b) administering a second effective amount of the composition of the invention listed above herein at a second, subsequent time period, wherein B memory cells directed against the heterologous protein are reactivated in the mammal.

In some embodiments, the mammal is a human.

BRIEF DESCRIPTION OF THE DRAWINGS

For the purpose of illustrating the invention, there are depicted in the drawings certain embodiments of the invention. However, the invention is not limited to the precise arrangements and instrumentalities of the embodiments depicted in the drawings.

FIGS. 1A-1D are series of graphs illustrating the neutralizing antibody titers to MW965 PV compared to non-specific neutralization of MuLV PV. FIGS. 1A-1C (groups 1-6, upper and lower graphs): sera of mice were tested after the last immunization at a 1:40 dilution for neutralization of the indicated pseudotyped lentiviruses. Data show % neutralization of each individual samples from the 6 groups. Median and IQR are indicated by lines. Differences to neutralization of the control were determined by Friedman test with Dunn correction. * indicates p-values below 0.05. FIG. 1D: titers of neutralizing antibodies against MW965 PV.

FIGS. 2A-2B are series of graphs and histograms illustrating sera binding studies from study mice. FIG. 2A displays results from sera of the same mice shown in FIGS. 1A-1D tested 4 weeks after each immunization at serial dilutions for binding to HIV-1 Glade C gp140. FIG. 2A shows the results for median adsorbance ±interquartile range (IQR) for data obtained with sera from individual mice tested at a 1:2000 dilution. Background data obtained with pre-bleeds were subtracted (OD<0.1). The bars below indicate the timing of priming (P) and boosting (B) for each group shown to the right. FIG. 2B shows samples from the $1^{st}$ bleeds after the last boost that were also tested for binding to a peptide expressing the sequence of the V2 loop of HIV-1 Glade C. Results show adsorbance after subtraction of pre-bleed results for the 1:100 dilution of sera. Dots show results for individual mice, bars the medians and error bars the IQR.

FIG. 3 is a table depicting the characteristics of the Rhesus Macaques (RM) tested in the present invention. Animals were distributed with high or low nAb responses to AdHu5 and AdHu26 equally into three groups of twelve RMs each. Each group had eight Mamu-A*$01^+$ RMs and groups 1 and 3 each had one Mamu-B*$17^+$ animal FIGS. 4A-4C are series of graphs illustrating virus acquisition, viral loads over time and levels of SIV genome integration. FIG. 4A shows viral titers over time in 12 control animals and 12 animals each vaccinated with AdC or AdHu vectors. Mamu-A*$01^-$/B*$17^-$ animals are highlighted in dark grey. The bottom graph to the right shows median titers for the three groups (Controls, "Co"; AdC7/AdC6, "AdC"; AdHu26/AdHu5, "AM"). Differences in viral loads (area under the curve) and set point viral loads were determined by Kruskal-Wallis test with Dunn correction. FIG. 4B shows as Kaplan-Meier curves infection according to weeks after 1St challenge in Mamu-A*$01^-$/B*$17^-$ (left, n=3 for AdC and controls, n=4 for AdHu5) and Mamu-A*$01^+$/B*$17^+$ RMs (right, n=9 for AdC and controls, n=8 for AdHu). Differences were calculated by Log-rank (Mantel Cox) test. FIG. 4C shows to the left relative levels of integrated SIV genome at 2 (light grey symbol) and 12 (dark grey symbol) weeks after infection of subcohorts of the animals (n=7 for AdC, n=11 for AdHu5, n=4 for controls). Each samples was tested by qPCR using 40-60 replicates. Outliers were excluded by median absolute deviation tests. Differences within one group between weeks 2 and 12 were determined by multiple t-tests. Differences between the three groups were calculated by 2-way Anova. The right graph shows number of challenges required till infection for AdC- and AdHu-vaccinated animals maintained stable levels of SIV integration (change <100, light grey symbol) or showed pronounced increases (change >100, dark grey symbol). Differences between animals of one group with high vs. low integration were calculated by multiple t-tests with Sidak-Holms correction.

FIGS. 5A-5C are series of graphs depicting the titers of Env-specific Abs. Env-specific Abs of individual animals were measured by ELISA. Graphs show median Ab titers ±IQR for serial dilutions of sera from for AdC (closed squares) and AdHu (open squares) vaccinated MamuA*$01^-$/B$17^-$ (FIG. 5A, n=3 for AdC- and 4 for AdHu-vaccinated animals) and Mamu-A*01+/B*17+ RMs (FIG. 5B, n=9 for AdC and 8 for AdHu-vaccinated animals). FIG. 5C shows titers of individual animals of the 3 groups after challenges (n=12 per group). Connecting lines indicate significant differences *p≤0.05, **p≤0.01 by Mann-Whitney tests.

FIGS. 6A-6B are series of dot plots demonstrating the role of Abs in preventing SIV acquisition. The graphs show Spearman's correlations between antibody titers at wk 32 and number of challenges need to achieve infection for AdC (FIG. 6A, n=10) and AdHu (FIG. 6B, n=11) vaccinated RMs. R- (correlation coefficient) and unadjusted p-values are shown within the graphs. Animals that were not infected after 10 challenges were excluded.

FIGS. 7A-7L are series of graphs depicting the kinetics of Gag-specific T cell responses. The graphs show frequencies of Gag-specific total CD8+ (FIG. 7A, FIG. 7G) and CD4+ (FIG. 7D, FIG. 7J), $CD8_{CM}$ (FIG. 7B, FIG. 7H), $CD4_{CM}$ (FIG. 7E, FIG. 7K), $CD8_{EM}$ (FIG. 7C, FIG. 7I) and $CD4_{EM}$ (FIG. 7F, FIG. 7L) T cells of AdC- (FIGS. 7A-7F) and AdHu- (FIGS. 7G-7L) vaccinated animals (n=12 per group) as the sum of all possible functionally distinct responses calculated from Boolean gating after subtraction of background responses. Each graph shows median responses ±IQR of Mamu-A*01−/B*17− (closed squares, n=3 for AdC- and n=4 for AdHu-vaccinated animals) and Mamu-A*01+/B*17+ (open squares, n=9 for AdC- and n=8 for AdHu-vaccinated animals) RMs. (*) indicates significant differences between the two subcohorts by Mann-Whitney tests.

FIG. 8. is a series of graphs showing the effect of CD8 depletion on serum viral loads. The graphs show relative viral loads of subcohorts of AdC (right, black squares, n=5) and AdHu (left, grey circles, n=4) animals that were treated 28 weeks after the last challenge with antibodies to CD8. Of note the one animal that had detectable titers before depletion also maintained titers by 65 days after antibody treatment had been in initiated.

FIG. 9 is a dot plot showing the cross-reactivity of Ad binding Abs. Pre-immunization sera and sera harvested 4 weeks after the $2^{nd}$ intra-tracheal administration of AdHu vectors from 16 RMs of groups 1 and 2 were tested for antibodies to the Ad vectors by ELISA on plates coated with Ad vectors expressing an irrelevant transgene. Adsorbance values of pre-bleeds were subtracted from those of immune sera before calculating titers. Graphs show titers of individual sera with lines indicating median titer ±IQR.

FIGS. 10A-10D are series of graphs depicting the role of viral loads and peak viral loads in increasing Ab titers after challenge. The graphs show correlations by Spearman between Ab titers at week 62 and viral loads (FIG. 10A, FIG. 10C) or peak viral loads (FIG. 10B, FIG. 10D) for AdC- (FIG. 10A, FIG. 10B, n=12) and AdHu- (FIG. 10C, FIG. 10D, n=12) vaccinated RMs. R- and unadjusted p-values are shown within the graphs.

FIG. 11 is a series of graphs illustrating Gag and Env-specific T cell responses of control animals. Six of the control animals were tested the day of first challenge and shortly after challenges for frequencies of Gag and Env specific CD4+ (closed black squares) and CD8+ (open white squares) T cells. Graphs show median frequencies ±IQR of individual animals before and after challenge±IQR.

FIGS. 12A-12F are series of dot plots depicting the effect of CD8+ T cell subsets on viral loads and peak viral loads. The graphs show correlations by Spearman between $CD8_{EM}$ (FIG. 12A, FIG. 12C, FIG. 12D, FIG. 12F) and $CD8_{CM}$ (FIG. 12B, FIG. 12E) frequencies after the boost and peak viral loads (FIG. 12A, FIG. 12B, FIG. 12D, FIG. 12E) or set viral loads over time (FIG. 12C, FIG. 12F) in AdC- (FIGS. 12A-12C, n=12) and AdHu- (FIGS. 12D-12F, n=12) vaccinated RMs. R- and unadjusted p-values are shown within the graphs.

FIGS. 13A-13D are series of dot plots depicting the effect of peak viral loads on CD4+ T cell subsets. The graphs show correlations by Spearman between total CD4+ T (FIG. 13A, FIG. 13C) and $CD4_{EM}$ (FIG. 13B, FIG. 13D) frequencies after challenges and peak viral loads for AdC- (FIG. 13A, FIG. 13B, n=12) and AdHu- (FIG. 13C, FIG. 13D, n=12) vaccinated RMs. R- and unadjusted p-values are shown within the graphs.

FIG. 14 is a series of graphs depicting the effect of Gag-specific CD8+ T cells on levels of SIV integration. The graph on the right shows frequencies of Gag-specific $CD8_{EM}$ T cells before challenge in animals with low levels of SIV integration by 2 weeks after infection (<50,000, dark grey symbol, AdC: n=4, AdHu: n=5) as compared to animals with high levels of integration (>50,000, light grey symbols, AdC: n=3, AdHu: n=6). Differences were determined by multiple t-tests with Sidak-Holms correction. The graphs in the middle and to the right show frequencies of Gag-specific $CD8_{CM}$ (middle) and $CD8_{EM}$ T cells (right) before challenge in animals with low levels of SIV integration by 12 weeks after infection (<$10^6$, dark grey symbol, AdC: n=4, AdHu: n=5) as compared to animals with high levels of integration (>$10^6$, light grey symbols, AdC: n=3, AdHu: n=6). Differences were determined by multiple t-tests with Sidak-Holms correction. Lines with star above indicate significant differences.

FIGS. 15A-15L are series of graphs illustrating Env-specific T Cell responses in vaccinated RMs. Frequencies of Env-specific total CD8+, $CD8_{CM}$ and $CD8_{EM}$, total CD4+ $CD4_{CM}$ and $CD4_{EM}$ T cells tested before and after challenges in 6 randomly selected control RMs are shown. Organization and symbols of the graph are identical to those of FIGS. 7A-7L.

FIG. 16 is a series of histograms demonstrating the functions of Gag-specific total CD8− T cells over time. The graphs show median frequencies ±IQR of Gag-specific CD8+ T cells from AdC- (left graphs) and AdHu- (right graphs) vaccinated Mamu-A*01"/B17− (white bars; AdC: n=3, AdHu: n=4) and Mamu-A*01+/B17+ RMs (grey bars; AdC: n=9, AdHu: n=8) exhibiting either of the possible 15 combinations of functions. Cells were tested at different times after vaccination. (#) indicates significant differences by Wilcoxon Rank test calculated by Spice software.

FIG. 17 is a series of histograms demonstrating the functions of Gag-specific total CD4− T cells over time. The graphs show frequencies of functionally distinct Gag-specific CD4+ T cells mirroring the design of FIG. 16. with Mamu-A*01−/B17− (white bars AdC: n=3, AdHu: n=4) and Mamu-A*01+/B17+ RMs (grey bars AdC: n=9, AdHu: n=8). (#) indicates significant differences by Wilcoxon Rank test calculated by Spice software.

FIG. 18 is a series of histograms demonstrating the functions of CD8+ and CD4+ T cell subsets. The graphs show median frequencies ±IQR of Gag-specific $CD8_{CM}$, $CD8_{EM}$, $CD4_{CM}$ and $CD4_{EM}$ from AdC- (left graphs) and AdHu- (right graphs) vaccinated Mamu-A*01−/B*17− (white bars; AdC: n=3, AdHu: n=4) and Mamu-A*01+/B*17+ RMs (grey bars; AdC: n=9, AdHu: n=8) exhibiting either of the possible 15 combination of functions. Cells were tested 48 weeks after priming, i.e., shortly before the $1^{st}$ SIV challenge. (#) indicates significant differences by Wilcoxon Rank test calculated by Spice software.

FIGS. 19A-19C are series of images depicting various maps and sequences of AdC6 and AdC7. FIGS. 19A-19B:

Maps of AdC6 and AdC7 vectors expressing Env. FIG. 19C: Maps of pShuttle plasmids containing gp140 (DU172 and DU422).

FIGS. 20A-20K are a list of the nucleotide (FIGS. 20A-20H) and amino acid (FIGS. 20I-20K) sequences of the AdC6 vector expressing gp140 (SEQ ID NOs: 1 and 9 respectively).

FIGS. 21A-21K are a list of the nucleotide (FIGS. 21A-21H) and amino acid (FIGS. 21I-21K) sequences of the AdC6 vector expressing Gag (SEQ ID NOs: 2 and 10 respectively).

FIGS. 22A-22K are a list of the nucleotide (FIGS. 22A-22H) and amino acid (FIGS. 22I-22K) sequences of the AdC7 vector expressing gp140 (SEQ ID NOs: 3 and 11 respectively)

FIGS. 23A-23K are a list of the nucleotide (FIGS. 23A-23H) and amino acid sequences (FIGS. 23I-23K) of the AdC7 vector expressing Gag (SEQ ID NOs: 4 and 12 respectively).

FIGS. 24A-24K are a list of the nucleotide (FIGS. 24A-24H) and amino acid sequences (FIGS. 24I-43K) of the AdC6 vector expressing gp160, construct DU172 (SEQ ID NOs: 5 and 13 respectively).

FIGS. 25A-25K are a list of the nucleotide (FIGS. 25A-25H) and amino acid (FIGS. 25I-25K) sequences of the AdC6 vector expressing gp160, construct DU422 (SEQ ID NOs: 6 and 14 respectively).

FIGS. 26A-26K are a list of the nucleotide (FIGS. 26A-26H) and amino acid (FIGS. 26I-26K) sequences of the AdC7 vector expressing gp160, construct DU172 (SEQ ID NOs: 7 and 15 respectively).

FIGS. 27A-27K are a list of the nucleotide (FIGS. 27A-27H) and amino acid (FIGS. 27I-27K) sequences of the AdC7 vector expressing gp160, construct DU422 (SEQ ID NOs: 8 and 16 respectively).

DETAILED DESCRIPTION OF THE INVENTION

Figures 1A, 1B:
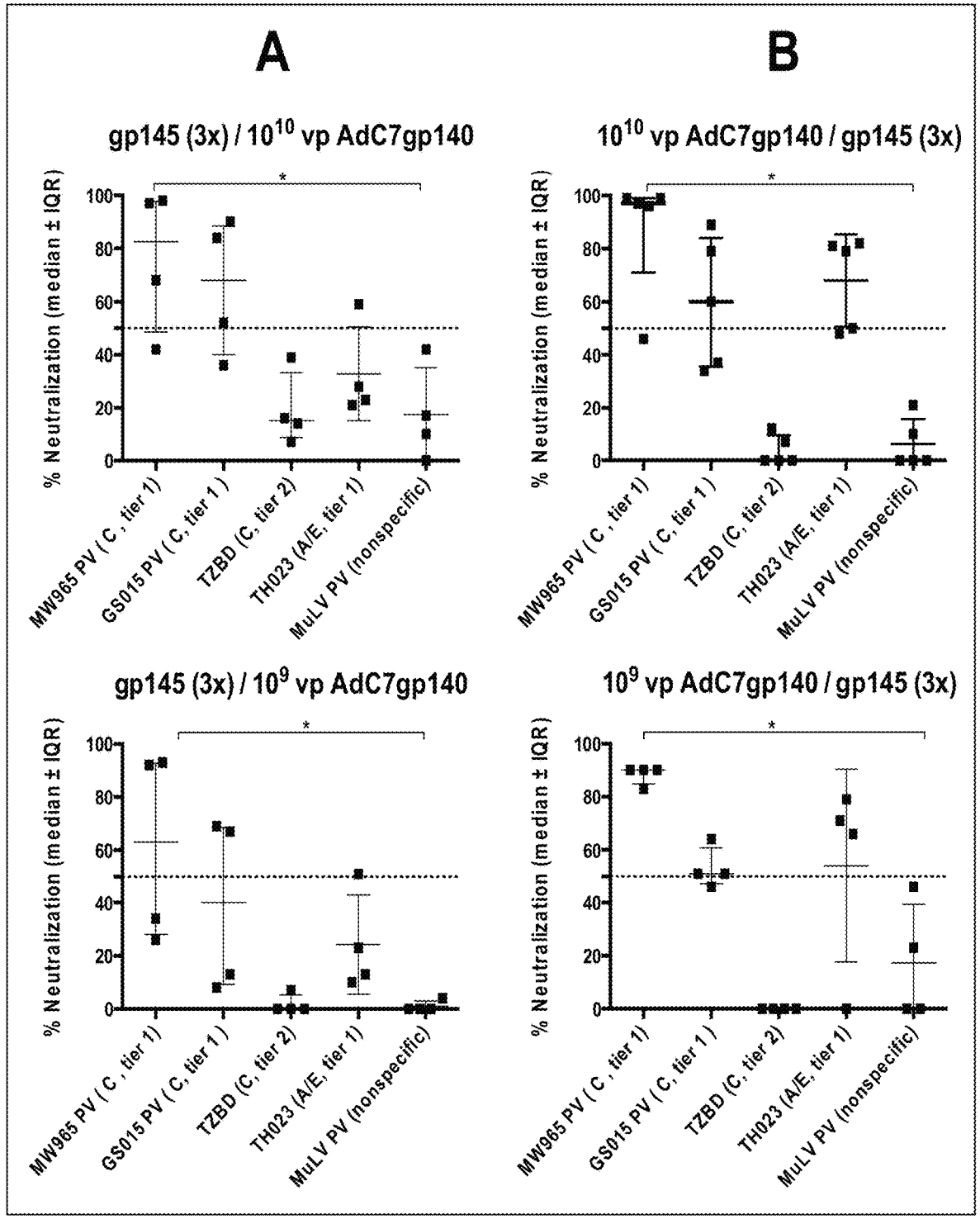
Figures 1C, 1D:
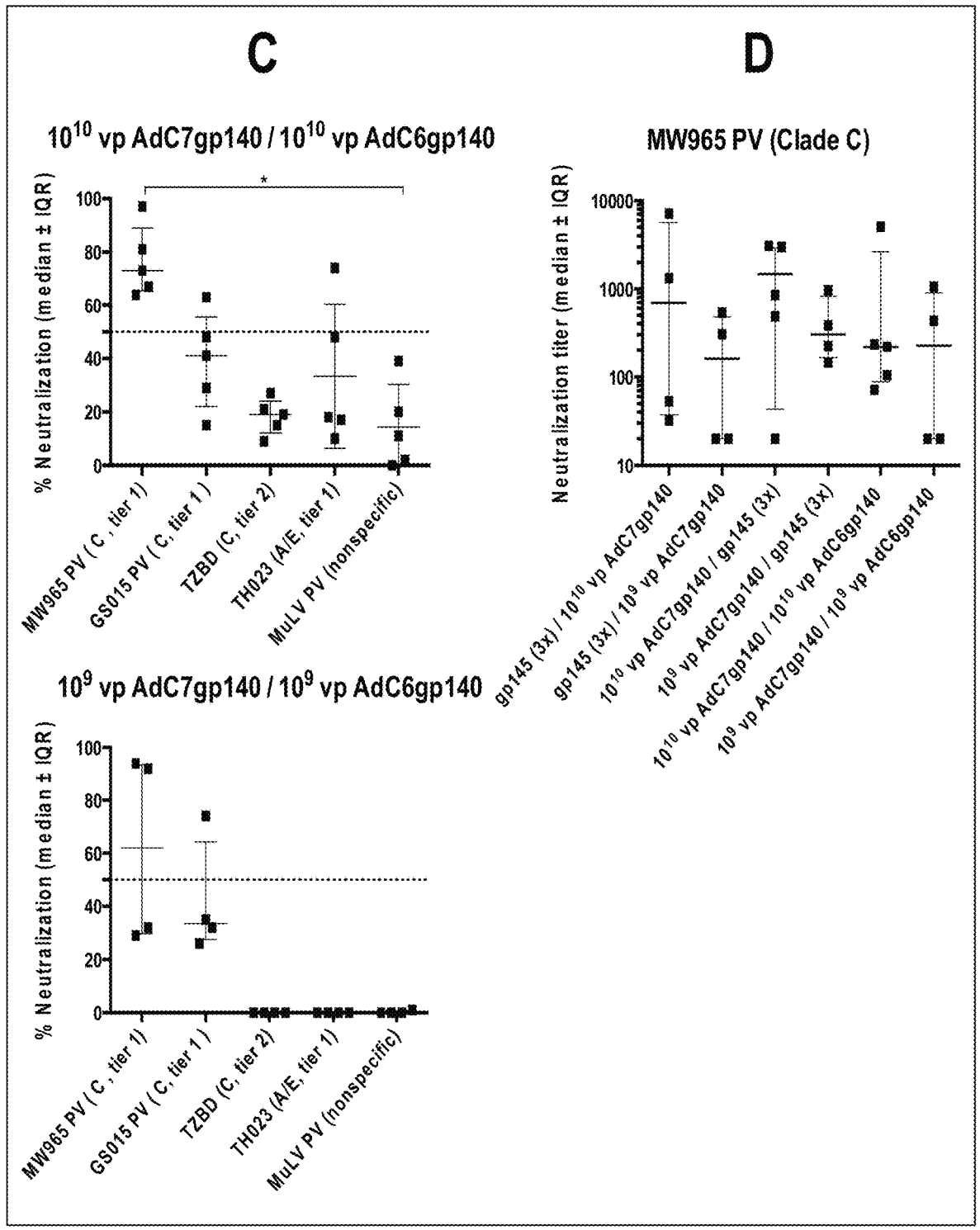

The present invention relates to compositions and methods for generating a chimpanzee-derived adenovirus vector comprising a nucleic acid sequence comprising a deletion in some of the adenovirus early genes (i.e. deletion of E1 and a partial deletion E3) and a promoter sequence linked to a sequence encoding a heterologous protein comprising, in certain embodiments, an HIV gp140, gp160, or HIV Gag protein or other potentially toxic proteins such as the rabies virus glycoprotein. Additionally, the current invention includes compositions and methods of treating of and/or preventing or immunizing against, a specific disease or disorder, and methods of inducing an effector and memory T and B cell immune response in a mammal administered the chimpanzee-derived adenovirus vector the invention.

Definitions

Unless defined otherwise, all technical and scientific terms used herein have the same meaning as commonly understood by one of ordinary skill in the art to which the invention pertains. Although any methods and materials similar or equivalent to those described herein may be used in the practice for testing of the present invention, the preferred materials and methods are described herein. In describing and claiming the present invention, the following terminology will be used.

It is also to be understood that the terminology used herein is for the purpose of describing particular embodiments only, and is not intended to be limiting.

As used herein, the articles "a" and "an" are used to refer to one or to more than one (i.e., to at least one) of the grammatical object of the article. By way of example, "an element" means one element or more than one element.

The term "antibody" or "Ab" as used herein, refers to a protein, or polypeptide sequence derived from an immunoglobulin molecule, which specifically binds to a specific epitope on an antigen. Antibodies can be intact immunoglobulins derived from natural sources or from recombinant sources and can be immunoreactive portions of intact immunoglobulins. The antibodies useful in the present invention may exist in a variety of forms including, for example, polyclonal antibodies, monoclonal antibodies, intracellular antibodies ("intrabodies"), Fv, Fab and F(ab)$_2$, as well as single chain antibodies (scFv) and humanized antibodies (Harlow et al., 1998, Using Antibodies: A Laboratory Manual, Cold Spring Harbor Laboratory Press, NY; Harlow et al., 1989, Antibodies: A Laboratory Manual, Cold Spring Harbor, N.Y.; Houston et al., 1988, Proc. Natl. Acad. Sci. USA 85:5879-5883; Bird et al., 1988, Science 242:423-426). An antibody may be derived from natural sources or from recombinant sources. Antibodies are typically tetramers of immunoglobulin molecules.

The term "ameliorating" or "treating" means that the clinical signs and/or the symptoms associated with a disease are lessened as a result of the actions performed. The signs or symptoms to be monitored will be well known to the skilled clinician.

As used herein when referring to a measurable value such as an amount, a temporal duration, and the like, the term "about" is meant to encompass variations of ±20% or ±10%, more preferably ±5%, even more preferably ±1%, and still more preferably ±0.1% from the specified value, as such variations are appropriate to perform the disclosed methods.

The term "biological" or "biological sample" refers to a sample obtained from an organism or from components (e.g., cells) of an organism. The sample may be of any biological tissue or fluid. Frequently the sample will be a "clinical sample" which is a sample derived from a patient. Such samples include, but are not limited to, bone marrow, cardiac tissue, sputum, blood, lymphatic fluid, blood cells (e.g., white cells), tissue or fine needle biopsy samples, urine, peritoneal fluid, and pleural fluid, or cells therefrom. Biological samples may also include sections of tissues such as frozen sections taken for histological purposes.

As used herein, "greater" refers to expression levels which are at least 10% or more, for example, 20%, 30%, 40%, or 50%, 60%, 70%, 80%, 90% higher or more, and/or 1.1 fold, 1.2 fold, 1.4 fold, 1.6 fold, 1.8 fold, 2.0 fold higher or more, and any and all whole or partial increments therebetween, than a control.

As used herein, the terms "control," or "reference" are used interchangeably and refer to a value that is used as a standard of comparison.

The term "immunogenicity" as used herein, refers to the innate ability of an antigen or organism to elicit an immune response in an animal when the antigen or organism is administered to the animal. Thus, "enhancing the immunogenicity" refers to increasing the ability of an antigen or organism to elicit an immune response in an animal when the antigen or organism is administered to an animal. The increased ability of an antigen or organism to elicit an immune response can be measured by, among other things, a greater number of antibodies that bind to an antigen or organism, a greater diversity of antibodies to an antigen or organism, a greater number of T-cells specific for an antigen or organism, a greater cytotoxic or helper T-cell response to an antigen or organism, a greater expression of cytokines in response to an antigen, and the like.

As used herein, the terms "eliciting an immune response" or "immunizing" refer to the process of generating a B cell and/or a T cell response against a heterologous protein.

The term "activation", as used herein, refers to the state of a cell following sufficient cell surface moiety ligation to induce a noticeable biochemical or morphological change. Within the context of T cells, such activation refers to the state of a T cell that has been sufficiently stimulated to induce cellular proliferation. Activation of a T cell may also induce cytokine production and performance of regulatory or cytolytic effector functions. Within the context of other cells, this term infers either up or down regulation of a particular physico-chemical process.

The term "activated T cell" means a T cell that is currently undergoing cell division, cytokine production, performance of regulatory or cytolytic effector functions, and/or has recently undergone the process of "activation."

The term "antigen" or "Ag" as used herein is defined as a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequences or a partial nucleotide sequence encoding a protein that elicits an immune response therefore encodes an "antigen" as that term is used herein. Furthermore, one skilled in the art will understand that an antigen need not be encoded solely by a full-length nucleotide sequence of a gene. It is readily apparent that the present invention includes, but is not limited to, the use of partial nucleotide sequences of more than one gene and that these nucleotide sequences are arranged in various combinations to elicit the desired immune response. Moreover, a skilled artisan will understand that an antigen need not be encoded by a "gene" at all. It is readily apparent that an antigen can be generated synthesized or can be derived from a biological sample. Such a biological sample can include, but is not limited to a tissue sample, a tumor sample, a cell or a biological fluid.

"Heterologous antigens" used herein to refer to an antigen that is not endogenous to the organism comprising or expressing an antigen. As an example, a virus vaccine vector comprising or expressing a viral or tumor antigen comprises a heterologous antigen. The term "Heterologous protein" as used herein refers to a protein that elicits a beneficial immune response in a subject (i.e. mammal), irrespective of its source.

By the terms "Human Immunodeficiency Virus" or HIV" as used herein is meant any HIV strain or variant that is known in the art or that is heretofore unknown, including without limitation, HIV-1 and HIV-2. HIV-1 is exemplified in certain embodiments disclosed herein.

The term "specifically binds", "selectively binds" or "binding specificity" refers to the ability of the humanized antibodies or binding compounds of the invention to bind to a target epitope with a greater affinity than that which results when bound to a non-target epitope. In certain embodiments, specific binding refers to binding to a target with an affinity that is at least 10, 50, 100, 250, 500, or 1000 times greater than the affinity for a non-target epitope.

As used herein, by "combination therapy" is meant that a first agent is administered in conjunction with another agent. "In combination with" or "In conjunction with" refers to administration of one treatment modality in addition to another treatment modality. As such, "in combination with" refers to administration of one treatment modality before, during, or after delivery of the other treatment modality to the individual. Such combinations are considered to be part of a single treatment regimen or regime.

"Humoral immunity" or "humoral immune response" both refer to B-cell mediated immunity and are mediated by highly specific antibodies, produced and secreted by B-lymphocytes (B-cells).

"Prevention" refers to the use of a pharmaceutical compositions for the vaccination against a disorder.

"Adjuvant" refers to a substance that is capable of potentiating the immunogenicity of an antigen. Adjuvants can be one substance or a mixture of substances and function by acting directly on the immune system or by providing a slow release of an antigen. Examples of adjuvants are aluminium salts, polyanions, bacterial glycopeptides and slow release agents as Freund's incomplete.

"Delivery vehicle" refers to a composition that helps to target the antigen to specific cells and to facilitate the effective recognition of an antigen by the immune system. The best-known delivery vehicles are liposomes, virosomes, microparticles including microspheres and nanospheres, polymeres, bacterial ghosts, bacterial polysaccharides, attenuated bacteria, virus like particles, attenuated viruses and ISCOMS.

"Incorporated into" or "encapsulated in" refers to an antigenic peptide that is within a delivery vehicle, such as microparticles, bacterial ghosts, attenuated bacteria, virus like particles, attenuated viruses, ISCOMs, liposomes and preferably virosomes.

As used herein, the terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that may comprise a protein or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. The polypeptides include natural peptides, recombinant peptides, synthetic peptides, or a combination thereof.

A "fusion protein" as used herein refers to a protein wherein the protein comprises two or more proteins linked together by peptide bonds or other chemical bonds. The proteins can be linked together directly by a peptide or other chemical bond, or with one or more amino acids between the two or more proteins, referred to herein as a spacer.

In the context of the present invention, the following abbreviations for the commonly occurring nucleic acid bases are used. "A" refers to adenosine, "C" refers to cytosine, "G" refers to guanosine, "T" refers to thymidine, and "U" refers to uridine.

The term "RNA" as used herein is defined as ribonucleic acid.

"Transform", "transforming", and "transformation" is used herein to refer to a process of introducing an isolated nucleic acid into the interior of an organism.

The term "treatment" as used within the context of the present invention is meant to include therapeutic treatment as well as prophylactic, or suppressive measures for the disease or disorder. As used herein, the term "treatment" and associated terms such as "treat" and "treating" means the reduction of the progression, severity and/or duration of a disease condition or at least one symptom thereof. The term 'treatment' therefore refers to any regimen that can benefit a subject. The treatment may be in respect of an existing condition or may be prophylactic (preventative treatment). Treatment may include curative, alleviative or prophylactic effects. References herein to "therapeutic" and "prophylactic" treatments are to be considered in their broadest context. The term "therapeutic" does not necessarily imply that a subject is treated until total recovery. Similarly, "prophylactic" does not necessarily mean that the subject will not eventually contract a disease condition. Thus, for example, the term treatment includes the administration of an agent prior to or following the onset of a disease or disorder thereby preventing or removing all signs of the disease or disorder. As another example, administration of the agent after clinical manifestation of the disease to combat the symptoms of the disease comprises "treatment" of the disease.

The term "equivalent," when used in reference to nucleotide sequences, is understood to refer to nucleotide sequences encoding functionally equivalent polypeptides. Equivalent nucleotide sequences will include sequences that differ by one or more nucleotide substitutions, additions- or deletions, such as allelic variants; and will, therefore, include sequences that differ from the nucleotide sequence of the nucleic acids described herein due to the degeneracy of the genetic code.

The term "isolated" as used herein with respect to nucleic acids, such as DNA or RNA, refers to molecules separated from other DNAs or RNAs, respectively that are present in the natural source of the macromolecule. The term isolated as used herein also refers to a nucleic acid or peptide that is substantially free of cellular material, viral material, or culture medium when produced by recombinant DNA techniques, or chemical precursors or other chemicals when chemically synthesized. Moreover, an "isolated nucleic acid" is meant to include nucleic acid fragments, which are not naturally occurring as fragments and would not be found in the natural state. The term "isolated" is also used herein to refer to polypeptides, which are isolated from other cellular proteins and is meant to encompass both purified and recombinant polypeptides. An "isolated cell" or "isolated population of cells" is a cell or population of cells that is not present in its natural environment.

A "mutation" as used therein is a change in a DNA sequence resulting in an alteration from its natural state. The mutation can comprise a deletion and/or insertion and/or duplication and/or substitution of at least one desoxyribonucleic acid base such as a purine (adenine and/or thymine) and/or a pyrimidine (guanine and/or cytosine). Mutations may or may not produce discernible changes in the observable characteristics (phenotype) of an organism.

As used herein, the term "nucleic acid" refers to polynucleotides such as deoxyribonucleic acid (DNA), and, where appropriate, ribonucleic acid (RNA). The term should also be understood to include, as equivalents, analogs of either RNA or DNA made from nucleotide analogs, and, as applicable to the embodiment being described, single (sense or antisense) and double-stranded polynucleotides. ESTs, chromosomes, cDNAs, mRNAs, and rRNAs are representative examples of molecules that may be referred to as nucleic acids.

As used herein, "operably linked" sequences include both expression control sequences that are contiguous with the gene of interest and expression control sequences that act in trans or at a distance to control the gene of interest. Expression control sequences include appropriate transcription initiation, termination, promoter and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product. There are numerous expression control sequences, including promoters which are native, constitutive, inducible and/or tissue-specific, are known in the art that may be used in the compositions of the invention. "Operably linked" should be construed to include RNA expression and control sequences in addition to DNA expression and control sequences.

The term "promoter" as used herein is defined as a DNA sequence recognized by the synthetic machinery of the cell, or introduced synthetic machinery, required to initiate the specific transcription of a polynucleotide sequence.

As used herein, the term "promoter/regulatory sequence" means a nucleic acid sequence, which is required for expression of a gene product operably linked to the promoter/regulatory sequence. In some instances, this sequence may be the core promoter sequence and in other instances, this sequence may also include an enhancer sequence and other regulatory elements, which are required for expression of the gene product. The promoter/regulatory sequence may, for example, be one which expresses the gene product in a tissue specific manner.

A "constitutive" promoter is a nucleotide sequence which, when operably linked with a polynucleotide which encodes or specifies a gene product, causes the gene product to be produced in a cell under most or all physiological conditions of the cell.

An "inducible" promoter is a nucleotide sequence which, when operably linked with a polynucleotide which encodes or specifies a gene product, causes the gene product to be produced in a cell substantially only when an inducer which corresponds to the promoter is present in the cell.

As used herein, the term "pharmaceutical composition" refers to a mixture of at least one compound useful within the invention with other chemical components, such as carriers, stabilizers, diluents, adjuvants, dispersing agents, suspending agents, thickening agents, and/or excipients. The pharmaceutical composition facilitates administration of the compound to an organism. Multiple techniques of administering a compound exist in the art including, but not limited to: intravenous, oral, aerosol, parenteral, ophthalmic, pulmonary and topical administration.

The language "pharmaceutically acceptable carrier" includes a pharmaceutically acceptable salt, pharmaceutically acceptable material, composition or carrier, such as a liquid or solid filler, diluent, excipient, solvent or encapsulating material, involved in carrying or transporting a compound(s) of the present invention within or to the subject such that it may perform its intended function. Typically, such compounds are carried or transported from one organ, or portion of the body, to another organ, or portion of the body. Each salt or carrier must be "acceptable" in the sense of being compatible with the other ingredients of the formulation, and not injurious to the subject. Some examples of materials that may serve as pharmaceutically acceptable carriers include: sugars, such as lactose, glucose and sucrose; starches, such as corn starch and potato starch; cellulose, and its derivatives, such as sodium carboxymethyl cellulose, ethyl cellulose and cellulose acetate; powdered tragacanth; malt; gelatin; talc; excipients, such as cocoa butter and suppository waxes; oils, such as peanut oil, cottonseed oil, safflower oil, sesame oil, olive oil, corn oil and soybean oil; glycols, such as propylene glycol; polyols, such as glycerin, sorbitol, mannitol and polyethylene glycol; esters, such as ethyl oleate and ethyl laurate; agar; buffering agents, such as magnesium hydroxide and aluminum hydroxide; alginic acid; pyrogen-free water; isotonic saline; Ringer's solution; ethyl alcohol; phosphate buffer solutions; diluent; granulating agent; lubricant; binder; disintegrating agent; wetting agent; emulsifier; coloring agent; release agent; coating agent; sweetening agent; flavoring agent; perfuming agent; preservative; antioxidant; plasticizer; gelling agent; thickener; hardener; setting agent; suspending agent; surfactant; humectant; carrier; stabilizer; and other non-toxic compatible substances employed in pharmaceutical formulations, or any combination thereof. As used herein, "pharmaceutically acceptable carrier" also includes any and all coatings, antibacterial and antifungal agents, and absorption delaying agents, and the like that are compatible with the activity of the compound, and are physiologically acceptable to the subject. Supplementary active compounds may also be incorporated into the compositions.

As used herein, the term "effective amount" or "therapeutically effective amount" means the amount of the virus like particle generated from vector of the invention which is required to prevent the particular disease condition, or which reduces the severity of and/or ameliorates the disease condition or at least one symptom thereof or condition associated therewith.

A "subject" or "patient," as used therein, may be a human or non-human mammal. Non-human mammals include, for example, livestock and pets, such as ovine, bovine, porcine, canine, feline and murine mammals. Preferably, the subject is human.

"Titers" are numerical measures of the concentration of a virus or viral vector compared to a reference sample, where the concentration is determined either by the activity of the virus, or by measuring the number of viruses in a unit volume of buffer. The titer of viral stocks are determined, e.g., by measuring the infectivity of a solution or solutions (typically serial dilutions) of the viruses, e.g., on HeLa cells using the soft agar method (see, Graham & Van Der eb (1973) Virology 52:456-467) or by monitoring resistance conferred to cells, e.g., G418 resistance encoded by the virus or vector, or by quantitating the viruses by UV spectrophotometry (see, Chardonnet & Dales (1970) Virology 40:462-477).

A "vector" is a composition of matter which comprises an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. In the present disclosure, the term "vector" includes an autonomously replicating virus.

Ranges: throughout this disclosure, various aspects of the invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to, 6 etc., as well as individual numbers within that range, for example, 1, 2, 2.7, 3, 4, 5, 5.3, and 6. This applies regardless of the breadth of the range.

DESCRIPTION

The invention provides chimpanzee-derived adenoviral vectors useful in vaccine development and gene therapy. These vectors comprise a deletion of the viral early genomic region E1, and a selective deletion of some of the nine open reading frames (ORFs) of the viral early genomic region E3 while retaining others. The disclosed vectors are particularly useful for vaccine development and therapy. Adenoviral vectors comprising such deletions are disclosed in U.S. application Ser. No. 14/190,787.

The present invention comprises the novel improvement over U.S. application Ser. No. 14/190,787 wherein the adenoviral vector encodes nucleic acid encoding a heterologous protein encoding HIV envelope protein gp140, wherein when the vector is introduced into a cell, the cell stably expresses gp140 protein, for over 12 serial passages of the vector within cells.

The present invention comprises the novel improvement over U.S. application Ser. No. 14/190,787 wherein the adenoviral vector encodes nucleic acid encoding a heterologous protein encoding HIV envelope protein gp160, wherein when the vector is introduced into a cell, the cell stably expresses gp160 protein, for over many serial passages of the vector within cells.

The present invention also comprises the novel improvement over U.S. application Ser. No. 14/190,787 wherein the adenoviral vector encodes nucleic acid encoding a heterologous protein encoding HIV Gag, wherein when the vector is introduced into a cell, the cell stably expresses gag protein, for over many serial passages of the vector within cells.

In one aspect, the heterologous protein is at least one HIV protein selected from the group consisting of gp140, gp160 and Gag. In another aspect, the heterologous protein is all or an antigenic portion of the HIV gp140, gp160 or HIV Gag proteins.

In one embodiment, the HIV serotype is HIV-1.

In some embodiments, the chimpanzee-derived adenovirus vector comprises a nucleic acid sequence comprising a constitutive promoter.

In some embodiments, the chimpanzee-derived adenovirus vector of this invention comprises a nucleic acid sequence consists of SEQ ID NOs: 1-4.

In other embodiments, the present invention relates to a protein expression system comprising a chimpanzee-derived adenovirus vector comprising a nucleic acid sequence selected from the group consisting of SEQ ID NOs: 1-4. In yet other embodiments, the protein expression system of this invention comprises a chimpanzee-derived adenovirus vector, wherein the vector comprises a nucleic acid sequence encoding an amino acid sequence selected from the group consisting of SEQ ID NOs: 5-8.

In one embodiment, the invention provides a method of generating effector and memory T cell immune responses to a heterologous protein in a mammal. The method comprises first administering to the mammal the chimpanzee-derived adenovirus vector of this invention in an amount effective to elicit an immune response in the mammal; and second, administering a second effective amount of the chimpanzee-derived adenovirus vector at a subsequent time period, wherein T memory cells directed against the heterologous protein are reactivated in the mammal.

In one embodiment, the invention provides a method of generating an adaptive B cell immune response to a heterologous protein in a mammal. The method comprises first administering to the mammal the chimpanzee-derived adenovirus vector of this invention in an amount effective to elicit an immune response in the mammal; and second, administering a second effective amount of the chimpanzee-derived adenovirus vector at a subsequent time period, wherein B memory cells directed against the heterologous protein are reactivated in the mammal.

In some aspects of the invention, the chimpanzee-derived adenovirus vector administered herein to a mammal, in a first and second step, comprises the same or a different: HIV heterologous protein selected from the group consisting of gp140, gp160 and Gag encoded by an adenovirus serotype selected from the group consisting of AdC6 and AdC7.

Vaccine compositions comprising adenovirus particles made using the adenovirus vectors disclosed herein can be used to induce immunity in a mammal against one or more encoded heterologous proteins or antigenic portions thereof. Immunity can be induced using the disclosed vaccine compositions or dosage units. Immune responses can be assessed using suitable methods known in the art, as disclosed, for example, in WO2012/02483.

In certain embodiments, the mammal is a human.

Heterologous Gene Expression

In one aspect, although the cytomegalovirus immediate early promoter is exemplified herein as the promoter driving expression of the HIV protein, the invention should not be construed to be limited to this promoter sequence. Promoter sequences that are useful in the invention include any promoter that induces high levels of gene expression. Such promoters may include, but are not limited to those disclosed elsewhere herein.

In one embodiment, a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. Further, the invention should not be limited to the use of constitutive promoters. Inducible promoters are also contemplated as part of the invention. The use of an inducible promoter provides a molecular switch capable of turning on expression of the polynucleotide sequence, which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In some embodiments, the invention further includes the use of a tissue-specific promoter that drives expression of a given heterologous gene in one or more specific types of cells (e.g., myoglobin promoter, muscle creatine kinase promoter, desmin promoter, mammalian troponin 1 promoter, and skeletal alpha-action promoter). Furthermore, any artificial synthetic promoters known in the art can be used in this invention as these promoters can provide optimal efficiency and stability for the heterologous gene. Additionally, enhancer sequences regulate expression of the gene contained within a vector. Typically, enhancers are bound with protein factors to enhance the transcription of a gene. Enhancers may be located upstream or downstream of the gene it regulates. Enhancers may also be tissue-specific to enhance transcription in a specific cell or tissue type.

In order to assess the expression of the heterologous gene of interest, the expression vector to be introduced into a cell can also contain either a selectable marker gene or a reporter gene or both to facilitate identification and selection of expressing cells from the population of cells sought to be infected through the hybrid-virus vectors. In other aspects, the selectable marker may be carried on a separate piece of DNA and used in a co-infection/transfection procedure. Both selectable markers and reporter genes may be flanked with appropriate regulatory sequences to enable expression in the host cells. Useful, selectable markers include, for example, antibiotic-resistance genes, such as the neomycin resistant gene and the like.

Reporter genes are used for identifying potentially infected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Suitable reporter genes may include genes encoding luciferase, beta-galactosidase, chloramphenicol acetyl transferase, secreted alkaline phosphatase, or the green fluorescent protein gene (e.g., Ui-Tei et al., 2000 FEBS Letters 479: 79-82).

It will be apparent to one skilled in the art that the invention is not limited to the nature of the heterologous gene that is expressed by the adenovirus vector of the invention. Any suitable heterologous gene can be used where expression of the gene provides a benefit to the mammal. For example, the heterologous gene may be a viral protein whose expression in a mammal confers immunity to infection by the virus. Similarly, the heterologous gene may be a bacterial antigen, a parasitic antigen, a fungal antigen, a cancer antigen, an antigen involved in a deleterious autoimmune reaction, or any other protein where an immune response directed thereto provides benefit.

Heterologous Proteins

In the present invention, the adenovirus vector of the invention may encode any heterologous protein useful in the invention, and may encode more than one heterologous protein inserted in tandem in the virus vector of the invention. Typically, the heterologous protein is a peptide fragment, polypeptide, protein or fusion protein. Optionally, the heterologous protein is suitable such that a cell-mediated immune response is induced against it in a mammal following administration of the vector to the mammal.

In one embodiment, the heterologous protein is derived from an HIV protein. In another embodiment, the heterologous protein is derived from HIV envelope glycoprotein. Non-limiting examples of HIV envelope glycoprotein are gp120, gp41, gp160 and gp140. In yet another embodiment, the heterologous protein is derived from REV Gag protein.

In some embodiments, the heterologous protein may be derived from a toxic protein such as, but not limited to, the rabies virus glycoprotein.

In some embodiments, the heterologous protein may be derived from a cancer. In such embodiments, heterologous protein is, or is a fragment of, a tumor specific antigen. In certain embodiments the cancer may be derived from the group including Acute and Chronic Myelogenous Leukemia (AML, CML), Follicular Non-Hodgkins lymphoma, malignant melanoma, Hairy Cell leukaemia, multiple myeloma, carcinoid tumors with carcinoid syndrome and liver and lymph node metastases, AIDS related Kaposi's sarcoma, renal cell carcinoma, adenocarcinoma of the large bowel, squamous cell carcinoma of the head and neck. The cancer may also be derived from organs and solid tissues, e.g., colon cancer, lung cancer, breast cancer, stomach cancer, prostate cancer, and endometrial cancer. When such heterologous proteins are used in the compositions and methods of the present invention, the resulting immune response generated may combat cancers and thus the vectors and viruses produced by these vectors are designed to be oncolytic.

In other embodiments, the heterologous protein may be associated with the pathology of an autoimmune disease. Organs and tissues commonly affected by autoimmune disorders include, but are not limited to, blood vessels, connective tissues, endocrine glands such as the thyroid or pancreas, joints, muscles, red blood cells and skin. Examples of autoimmune (or autoimmune-related) disorders for which such heterologous proteins may be useful include, but are not limited to, Addison's disease, Celiac disease, Dermatomyositis, Graves' disease, Hashimoto's thyroiditis, Multiple sclerosis; Myasthenia gravis, Pernicious anemia, Reactive arthritis, Rheumatoid arthritis, Sjogren syndrome, Systemic lupus erythematosus and Type I diabetes.

Methods of the Invention

The vectors of the invention are useful in a variety of applications useful for immunizing a mammal against disease, and/or treating, preventing or diminishing risk of disease in a mammal.

The invention therefore includes a method of immunizing a mammal against a heterologous protein. The method comprises administering to the mammal a composition comprising a composition comprising a chimpanzee-derived adenovirus (Ad) vector comprising a DNA sequence comprising a deletion in E1, a deletion of E3 ORF3, ORF4, ORF5, ORF6, and ORF7 and a promoter sequence linked to a sequence encoding a heterologous protein, wherein expression of the heterologous protein induces an immune response in the mammal. In one embodiment the chimpanzee-derived Ad vector is AdC6. In another embodiment the chimpanzee-derived Ad vector is AdC7.

The invention further includes a method of treating a mammal in need thereof where the method administering a therapeutically effective amount of a composition encoded by a chimpanzee-derived adenovirus vector comprising a DNA sequence consisting of SEQ ID NOs: 1-4, wherein expression of the heterogeneous gene provides benefit to the mammal. In one aspect, the invention includes a method of generating effector and memory T cell immune responses to a heterologous protein in a mammal. In another aspect, the invention includes a method of generating an adaptive B cell immune response to a heterologous protein in a mammal.

Additionally included in the invention is a method of diminishing the risk that a mammal will develop a disease. The method comprises administering to the mammal a composition comprising a composition comprising a chimpanzee-derived adenovirus vector comprising a DNA sequence comprising a deletion in E1, a deletion of E3 ORF3, ORF4, ORF5, ORF6, and ORF7 and a promoter sequence linked to a sequence encoding a heterologous protein. Expression of the heterogeneous gene (e.g. HIV gp140, gp160 or Gag protein) induces an immune response to the heterologous protein encoded thereby in the mammal, thereby diminishing the risk that the mammal will develop a disease (e.g. HIV-1) associated with the heterologous protein.

Adenovirus Vector Production

Methods of making the adenovirus vector of the invention are described in detail in the Experimental Examples Section herein and in U.S. application Ser. No. 14/190,787 incorporated herein by reference. In general, production, purification and quality control procedures for Adenovirus vectors are well established in the art. Once a vector backbone is created, molecular cloning can be used to create an adenoviral plasmid comprising a coding sequence for an antigenic heterologous protein. The plasmid can be transfected into packaging cells that provide E1 of a suitable adenovirus serotype in trans. Packaging cells are well known in the art, and cells lines such as HEK293 or PERC6 can be used for this purpose. Viral particles are then harvested once plaques become visible. Fresh cells can then be infected to ensure continued replication of the adenovirus. Quality can be assessed using Southern blotting or other methods, such as restriction enzyme mapping, sequencing, and PCR, to confirm the presence of the transgene and the lack of gene rearrangements or undesired deletions.

Vaccine compositions comprising adenovirus particles made using the adenovirus vectors disclosed herein can be used to induce immunity against the encoded antigenic protein. Vaccines can be formulated using standard techniques and can comprise, in addition to a replication-incompetent adenovirus vector encoding a desired protein, a pharmaceutically acceptable vehicle, such as phosphate-buffered saline (PBS) or other buffers, as well as other components such as antibacterial and antifungal agents, isotonic and absorption delaying agents, adjuvants, and the like. In some embodiments vaccine compositions are administered in combination with one or more other vaccines. Dosage units of vaccine compositions can be provided. Such dosage units typically comprise $10^8$ to $10^{11}$ adenoviral particles (e.g., $10^8$, $5 \times 10^8$, $10^9$, $5 \times 10^9$, $10^{10}$, $5 \times 10^{10}$, $10^{11}$). In some embodiments, the dosage of $5 \times 10^{10}$ virus particles is of choice. Particularly, this dosage ($5 \times 10^{10}$) suits best humans in clinical trials.

Pharmaceutical Compositions and Formulations.

The vector of the invention may be formulated as a pharmaceutical composition.

Such a pharmaceutical composition may be in a form suitable for administration to a subject (i.e. mammal), or the pharmaceutical composition may further comprise one or more pharmaceutically acceptable carriers, one or more additional ingredients, or some combination of these. The various components of the pharmaceutical composition may be present in the form of a physiologically acceptable salt, such as in combination with a physiologically acceptable cation or anion, as is well known in the art.

In one embodiment, the pharmaceutical compositions useful for practicing the method of the invention may be administered to deliver a dose of between $10^6$ and $10^{12}$ PFU.

In one embodiment, the pharmaceutical compositions useful for practicing the method of the invention may comprise an adjuvant. Non-limiting examples of suitable are Freund's complete adjuvant, Freund's incomplete adjuvant, Quil A, Detox, ISCOMs or squalene.

Pharmaceutical compositions that are useful in the methods of the invention may be suitably developed for inhalation, oral, rectal, vaginal, parenteral, topical, transdermal, pulmonary, intranasal, buccal, ophthalmic, intrathecal, intravenous or another route of administration. Other contemplated formulations include projected nanoparticles, liposomal preparations, resealed erythrocytes containing the active ingredient, and immunologically-based formulations. The route(s) of administration is readily apparent to the skilled artisan and depends upon any number of factors including the type and severity of the disease being treated, the type and age of the veterinary or human patient being treated, and the like.

Although the descriptions of pharmaceutical compositions provided herein are principally directed to pharmaceutical compositions suitable for ethical administration to humans, it is understood by the skilled artisan that such compositions are generally suitable for administration to animals of all sorts. Modification of pharmaceutical compositions suitable for administration to humans in order to render the compositions suitable for administration to various animals is well understood, and the ordinarily skilled veterinary pharmacologist can design and perform such modification with merely ordinary, if any, experimentation. Subjects to which administration of the pharmaceutical compositions of the invention is contemplated include, but are not limited to, humans and other primates, mammals including commercially relevant mammals such as cattle, pigs, horses, sheep, cats, and dogs.

The composition of the invention may comprise a preservative from about 0.005% to 2.0% by total weight of the composition. The preservative is used to prevent spoilage in the case of exposure to contaminants in the environment.

Administration/Dosing

The regimen of administration may affect what constitutes an effective amount. For example, the adenovirus vector of the invention may be administered to the subject (i.e. mammal) in a single dose, in several divided dosages, as well as staggered dosages may be administered daily or sequentially, or the dose may be continuously infused, or may be a bolus injection. Further, the dosages may be proportionally increased or decreased as indicated by the exigencies of the therapeutic or prophylactic situation.

Administration of the compositions of the present invention to a subject, preferably a mammal, more preferably a human, may be carried out using known procedures, at dosages and for periods of time effective to treat the disease in the subject. An effective amount of the composition necessary to achieve the intended result will vary and will depend on factors such as the disease to be treated or prevented, the age, sex, weight, condition, general health and prior medical history of the subject being treated, and like factors well-known in the medical arts. In particular embodiments, it is especially advantageous to formulate the composition in dosage unit form for ease of administration and uniformity of dosage. Dosage unit form as used herein refers to physically discrete units suited as unitary dosages for the subjects to be treated; each unit containing a predetermined quantity of therapeutic compound calculated to produce the desired therapeutic effect in association with the required pharmaceutical vehicle. The dosage unit forms of the invention are dictated by and directly dependent on (a) the unique characteristics of the composition and the heterologous protein to be expressed, and the particular therapeutic effect to be achieved.

Routes of Administration

One skilled in the art will recognize that although more than one route can be used for administration, a particular route can provide a more immediate and more effective reaction than another route. Routes of administration of any of the compositions\ of the invention include inhalation, oral, nasal, rectal, parenteral, sublingual, transdermal, transmucosal (e.g., sublingual, lingual, (trans)buccal, (trans)urethral, vaginal (e.g., trans- and perivaginally), (intra)nasal, and (trans)rectal), intravesi cal, intrapulmonary, intraduodenal, intragastrical, intrathecal, subcutaneous, intramuscular, intradermal, intra-arterial, intravenous, intrabronchial, inhalation, and topical administration.

Kits

In some embodiments a kit is provided for treating, preventing, or ameliorating an a given disease, disorder or condition, or a symptom thereof, as described herein wherein the kit comprises: a) a compound or compositions as described herein; and optionally b) an additional agent or therapy as described herein. The kit can further include instructions or a label for using the kit to treat, prevent, or ameliorate the disease, disorder or condition. In yet other embodiments, the invention extends to kits assays for a given disease, disorder or condition, or a symptom thereof, as described herein. Such kits may, for example, contain the reagents from PCR or other nucleic acid hybridization technology (microarrays) or reagents for immunologically based detection techniques (e.g., ELISpot, ELISA).

EXAMPLES

The invention is now described with reference to the following Examples. These Examples are provided for the purpose of illustration only and the invention should in no way be construed as being limited to these Examples, but rather should be construed to encompass any and all variations which become evident as a result of the teaching provided herein.

Without further description, it is believed that one of ordinary skill in the art can, using the preceding description and the following illustrative examples, make and utilize the compounds of the present invention and practice the claimed methods. The following working examples therefore, specifically point out the preferred embodiments of the present invention, and are not to be construed as limiting in any way the remainder of the disclosure.

The results of the experiments are now described in the following examples.

Example 1: Advantage of Using Recombinant AdC6 and AdC7 Vaccines

E1-deleted Ad vectors of human and simian serotypes have been tested extensively in the clinic. They are well tolerated at immunogenic doses. They induce very potent cellular responses and are also able to elicit potent and sustained humoral responses to a wide variety of transgene inserts as has been established in animals. Neutralizing antibodies commonly found to human serotypes of Ad vectors can impair immune responses to the transgene product. In the present invention, the combined sequential usage of two serologically distinct AdC vectors (e.g. AdC6 and AdC7) in a heterologous prime-boost regimen (see Example 6) is of particular interest. The rationale is that such a regimen outperforms homologous prime-boost regimens where neutralizing antibodies to the prime vaccine carrier impair immune responses to the boost. This problem is avoided if two serologically distinct AdC vectors are combined in a prime-boost regimen. In some embodiments, the prime-boost with the two serologically distinct AdC vectors is also followed by additional boosts with a protein vaccine.

Example 2: Goals and Objectives

The safety of the AdC6-HIVgp140 and AdC7-HIVgp140 vectors are assessed herein for the first time in humans. The present invention relates to a method of developing a vaccine regimen in which AdC vectors expressing the viral envelope (Env) are combined with other vaccine components. HIV-1 infection is best prevented by vaccines that induce both antibodies that block infection either by neutralization or by preventing passage of the virus through the mucosa. $CD8^+$ T cells rapidly eliminate cells infected with virus that escaped the antibody barrier. The Env protein, including but not limited to gp140 and gp160, is the primary target of virion binding or neutralizing antibodies while the group-specific antigen (Gag) is a prime target for $CD8^+$ T cells.

Example 3: Preclinical Immunogenicity/Efficacy Studies in Mice

Studies in mice and nonhuman primates were performed herein to evaluate the immunogenicity of study candidates AdC6 and AdC7 vectors. Studies in mice in which animals were primed with an AdC7 vector expressing Env and then boosted with either Env protein constructs or Virus-Like Particles (VLPs) containing Env Clade C were also conducted.

In one of the present study conducted in outbred ICR mice, pre-immunization sera were collected to determine background antibody titers. Animals were then divided into 6 groups of 5 mice each. Groups 1 and 2 were primed 3 times in monthly intervals intramuscularly (i.m.) with 10 µg of gp145 protein of CO6980v0c22 ($gp145_{CO6980}$) in alum; four weeks later Group 1 was boosted i.m. with $10^{10}$ vp of an AdC7 vector expressing gp140 of Du172, a Glade C virus, and Group 2 was boosted with the same vector at $10^9$ vp. For Groups 3 and 4 the order was reversed; mice were primed with the $AdC7-gp140_{Du172}$ vectors at the two different doses ($10^{10}$ vp and $10^9$ vp) respectively, and then boosted 8 weeks later 3 times in monthly intervals with $gp145_{CO6980}$ in alum. Group 5 was primed with $10^{10}$ vp of an $AdC7-gp140_{Du172}$ and were boosted 2 months later with AdC6 expressing Du422, another Glade C virus. Group 6 received the same regimen but vectors were used at a reduced dose of $10^9$ vp. Pre-immunization sera and sera collected at 2-6 weeks after the last dose (Groups 1 and 2: 6 weeks; Groups 3 and 4: 2 weeks; Groups 5 and 6: 4 weeks) were tested for neutralizing antibodies to pseudoviruses (PV) based on two tier 1 Glade C viruses (MW065, GS015), one Glade C tier 2 virus (TZBD), one Glade A/E tier 1 virus (TH023) as well as to MuLV PVs; the latter to assess non-specific neutralization. Sera from one mouse in Groups 1, 2, 4 and 6 each had neutralizing antibodies at baseline; they were excluded from the analysis. As shown in FIGS. 1A-1D, all of the regimens induced significant titers of neutralizing antibodies to MW965 PV when compared to non-specific neutralization of MuLV PV.

Figure 2A:
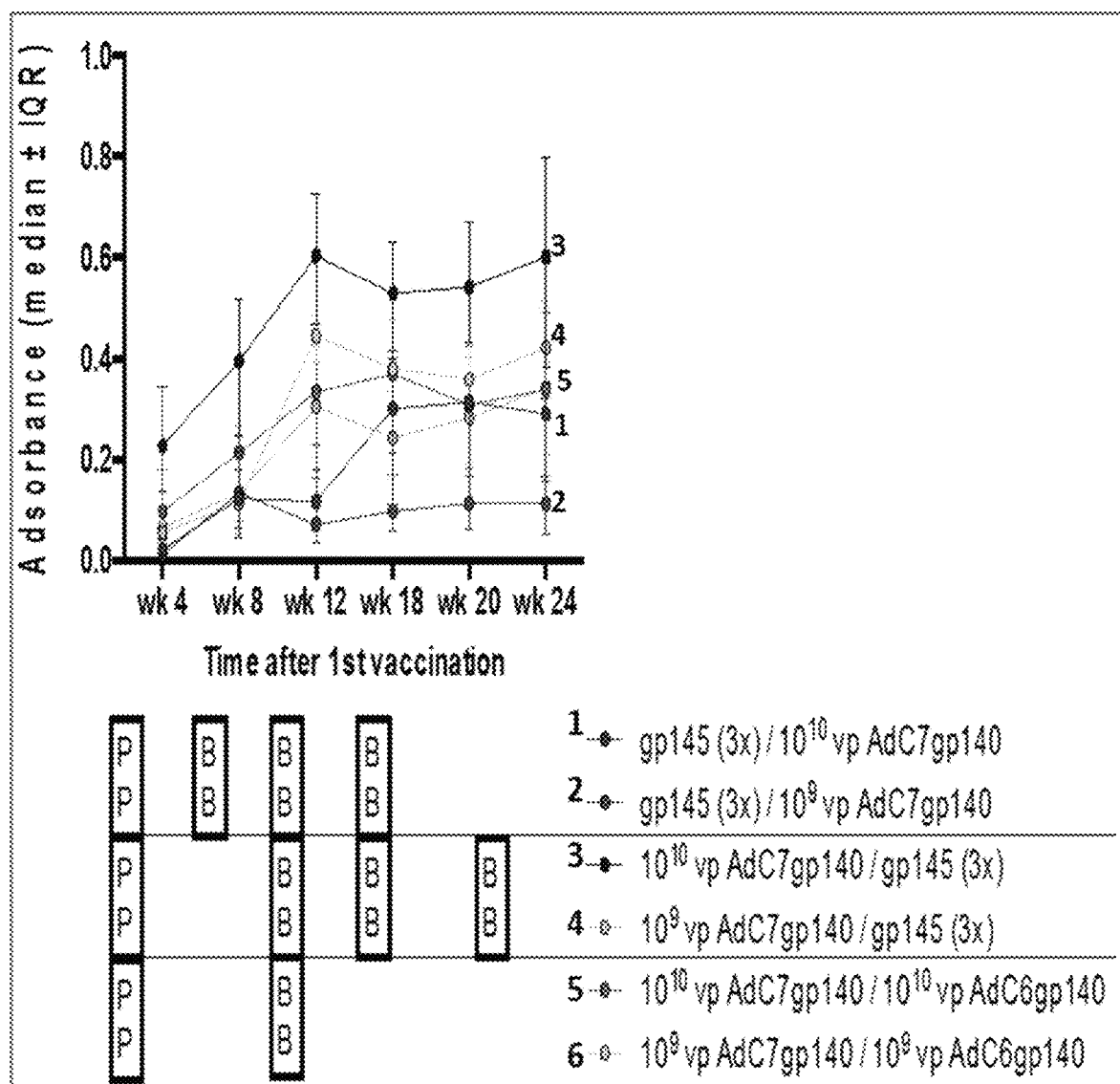
Figure 2B:
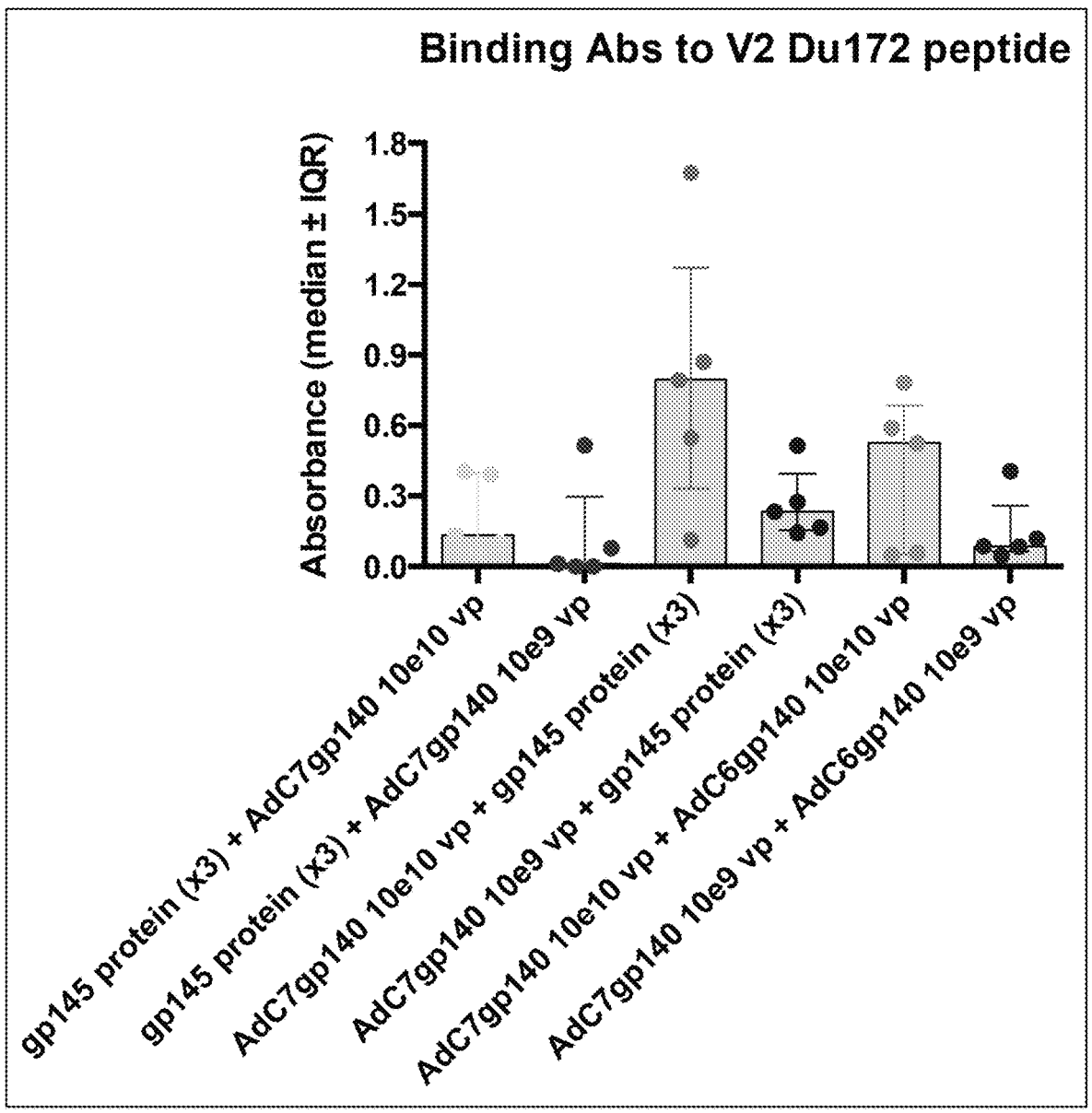

Some mice also developed antibodies that neutralized GS015 and/or TZBD PV; neutralization of the Glade C tier 2 PV was not achieved. The regimen in which the Ad vector was used for priming achieved higher seroconversion rates compared to regimens in which mice were primed with gp145 protein. Ad vectors given in a prime-boost regimen without protein also induced neutralizing antibodies with seroconversion rates depending on vector dose. Titers of neutralizing antibodies tested against MW965 PV were variable; several mice had titers above 1:1000. Highest median titers (1:860) were achieved by group 3. To assess induction of binding antibodies, sera collected at baseline and after each immunization were tested by ELISA on a baculovirus-derived Du172 gp140 (Glade C Du 422) protein as described by Bauer et al. (Bauer et al., 2005 September; 43(9):4426-33). Trends were similar to those obtained by neutralization assays (FIG. 2A). A prime-boost regimen with the protein resulted in low antibody responses after AdC vector boost. Prime-boosting with the two serologically distinct AdC vectors resulted in slightly higher responses and there was no difference between the groups receiving either of the two vector doses. Highest titers were achieved by priming with the AdC7-gp140 vector followed by protein boosts. In this regimen increasing the dose of AdC vector augmented antibody responses. Unexpectedly, maximal titers were achieved after a single protein boost. Ad vector prime followed by the protein boost or a boost with another Ad vector also induced antibodies to the V2 loop especially at the higher vector dose (FIG. 2B). Overall these results showed that a combination of AdC vector priming followed by protein boosts results in solid neutralization of several tier 1 viruses as well as binding antibody responses to HIV-1.

Example 4: Preclinical Immunogenicity/Efficacy Studies Testing in Nonhuman Primates AdC7, AdC6 as well as AdC68 and AdC1/C5 vectors expressing sequences from HIV-1 or SIV were tested to assess immunogenicity (Tatsis et al., J Immunol. 2009; 182:6587-99) or efficacy against $SIV_{mac}$ challenges in non-human primates, (Cervasi et al., J Virol. 2013 Jun. 26; Lasaro et al, Mol Ther. 2011; 19:417-26). Vectors were immunogenic even in animals with pre-existing immunity to human serotype adenoviruses. In the most crucial rhesus macaque (RM) efficacy trial, animals were vaccinated with an AdC7/AdC6 prime-boost regimen using vectors expressing Gag mixed with vectors expressing gp160 of $SIV_{mac239}$. Protection from $SIV_{mac251}$ acquisition or disease progression was measured.

The materials and methods employed in the experiments in the study disclosed herein are now described.
Material and Methods
Vaccine Vectors Ad vectors were derived from the chimpanzee serotypes 6 (AdC6) or 7 (AdC7) and human serotypes 5 (AdHu5) and 26 (AdHu26). The E1- and E3-deleted Ad vectors expressed Gag or gp160 of $SIV_{mac239}$ (AdHu5gag/gp160, AdHu26gag/gp160, AdC6gag/AdC6gp160 and AdC7gag/AdC7gp160) or the glycoprotein of rabies virus (rab.gp). Vectors were generated, rescued and expanded on HEK 293 cells obtained from the American Type Culture Collection; they were purified, titrated and quality controlled (Zhou et al. Nat Protoc. 5,1775-85 (2010)). Expression of Gag or gp160 from recombinant viruses was confirmed by Western blot analyses of lysates of infected cells.

Non-Human Primates (NHPs)

Two to three year-old, healthy and SIV-uninfected Indian origin *Macaca mulatta* were purchased and housed at Bioqual, Inc. (Rockville, Md.). Animals were typed for Mamu-A*01, A*02, A*08, A*11, B*01, B*03, B*04, B*08 and B*17 alleles (UW AIDS Vaccine Research Lab, Madison, Wis.). All procedures involving handling and sacrifice of animals were performed according to approved protocols and upon approval by the relevant Institutional Animal Care and Usage Committees.

Analyses of Ad-Specific Antibodies

All NHPs were screened prior to enrollment for nAbs to AdC6 and AdC7 vectors (Patel et al., Proc Natl Acad Sci USA 110, 2975-2980 (2013)) and were found to be seronegative. Some animals were tested for binding Abs to the Ad vectors by ELISA (Patel V, et al. Proc Natl Acad Sci USA 110, 2975-2980 (2013)). Titers were calculated by determining the area under the curve (AUC) obtained by adsorbance at different dilutions after subtraction of pre-bleed results. Negative values were ignored.

Immunization Regimen

Thirty-six RMs were enrolled. All animals were injected twice in ~a monthly interval intra-tracheally with $1 \times 10^{11}$ vp of an AdHu5rab.gp and AdHu26rab.gp vectors. Animals were bled 2 weeks after the last immunization to determine nAb titers to the AdHu viruses. Animals were then distributed according to genotypes and nAbs to the AdHu viruses into 3 groups of 12 animals each. Twelve animals were primed intramuscularly with $5 \times 10^{10}$ vp of AdC7gag mixed with $5 \times 10^{10}$ vp of AdC7gp160; they were boosted 6 months later with the same dose of AdC7 vectors expressing the same insert. Another 12 animals were primed with AdHu26 vectors and boosted 6 months later with AdHu5 vectors expressing the same inserts and used at the same doses. The remaining 12 animals were not immunized.

Viral Challenge

Six months after the boost, experimental and control RMs were challenged rectally 10 times in weekly intervals with 1 infectious dose of $SIV_{mac251}$ (most kindly provided by Nancy Miller, DAIDS, Bethesda, Md.).

Plasma Viral Load

Plasma SIV viral load was determined by quantitative real-time RT-PCR as previously described (Lewis et al., Retrovirology 7, 21 (2010)). Peak viral loads reflect the highest viral load obtained within an animal. Set-point viral loads reflect viral loads over time by calculating AUG with a Y=40 as baseline.

Virus Integration

Genomic DNA was extracted from $10^6$ peripheral blood mononuclear cells (PBMCs) using DNeasy Blood and Tissue Kit (Qiagen). Ten nanograms of DNA were amplified by PCR using a mix of forward primers for simian and human Alu sequences, and reverse primers for SIVgag. The following primers were used for the first PCR: simian Alu, 5'-TTCGCGGTGGCTCACGCCTG-3' (SEQ ID NO: 17); human Alu, 5'-TAGTCGGGAGGCTGAGGCAGGAGAA-3'(SEQ ID NO: 18); SIVgagR1, 5'-TCTCTTCTGCGT-GAATGCACC-3'(SEQ ID NO: 19); SIVgagR2, 5'-AAGGCTTTTTAAATTTTCTGAGCCTG-3'(SEQ ID NO: 20). The PCR conditions were as follow: 94° C. for 1 min, 20 cycles of 94° C. for 30 s, 57° C. for 30 s, and 72° C. for 30 s, with final elongation at 72° C. for 1 min. GapDH was used as a sample normalizer in the same conditions, with primer sequences 5'-TGCCACCCAGAA-GACTGTGG-3' (SEQ ID NO: 21) and 5'-ACCAGGAAAT-GAGCTTGACAAAG-3'(SEQ ID NO: 22). Two microliters of the amplicon were digested with 10 units of RecJf for 30 minutes at 37° C., followed by enzyme inactivation at 65° C. for 20 minutes. The digestion product was used as template for a nested real-time PCR (50° C. for 20 s, 95° C. for 10 min, and 35 cycles of 95° C. for 15 s and 60° C. for 1 min). The real-time PCR was performed utilizing the previously described mix of reverse SIVgag primers, and a forward primer specific for the LTR region of SIV: 5'-AG-GAAGAGGCCTCCGGTTG-3'(SEQ ID NO: 23). All real-time PCR samples were quantified by normalization in comparison to GAPDH sequences using the forward and reverse primers, respectively: 5'-TCCGG-GAAACTGTGGCGTG-3'(SEQ ID NO: 24); 5'-TCCCGTTCAGCTCAGGGATG-3'(SEQ ID NO: 25).

$CD8^+$ Cell Depletion

RMs were injected with antibody depleting anti-CD8alpha (cM-T807R1, NIH Reagent Source, NIH) first subcutaneously at 10 mg/kg, then intravenously at 5 mg/kg on days 0, 3, 7 and 10.

ELISA for Env-Specific Abs

Sera of individual RMs were tested for gp160-specific antibodies by an ELISA on plates coated with a baculovirus-derived gp160 protein (Lewis et al., Retrovirology 7, 21 (2010)). Antibodies to the V2 loop were measured by a peptide ELISA. Briefly, 10 mM of V2 peptide was used to coat wells of Nunc 96-well plates (Thermo Fisher Scientific, Rochester, N.Y.) by incubating 50 µl of the peptide dilution at 85 nmol/l in 0.02 mol/l NaCl at 4° C. overnight. Plates were blocked for 2 hours at room temperature with PBS containing 3% bovine serum albumin. After washing, they were incubated for 1 hour with serial dilutions of sera in PBS+3% bovine serum albumin followed by incubation with 1:30,00 dilution of alkaline phosphatase-conjugated goat anti-mouse IgG (Sigma) for 1 hour at room temperature. After being washed, plates were incubated for 20 minutes with substrate and then read in an automated ELISA reader at 405 nm. Titers were calculated by determining the AUC obtained by adsorbance at different dilutions after subtraction of pre-bleed results. Negative values were ignored.

Isolation and Preservation of Lymphocytes

PBMCs were isolated (Tatsis et al., J Immunol. 182, 6587-6599 (2009)) and tested immediately after isolation or frozen in 90% FBS and 10% dimethyl sulfoxide (Sigma, St. Louis, Mo.) at −80° C. until testing.

Synthetic Peptides

Peptide pools of 15-mers (overlapping by 11 amino acids) spanning the $SIV_{mac239}$ Gag and Env proteins were reconstituted in DMSO and pools were prepared from individual peptide stocks obtained from the National Institutes of Health AIDS Research and Reference Reagent Program.

Intracellular Cytokine Staining (ICS)

The function of SIV-specific $CD8^+$ T cells was assessed by ICS after stimulation with SW Gag or Env peptide pools. All peptides were used at a final concentration of 2 µg of each peptide per ml. When used, frozen cells were thawed and immediately washed with RPMI media, resuspended with RPMI media, rested overnight and then stimulated for 6 hrs with Brefeldin A and Monensin along with CD107a FITC (H4A3). First, cells were stained with anti-CCR7-PE-Cy7 (clone 3D12) at 37° C. Cells were stained with Aqua-fluorescent reactive dye, anti-CD14-QDot 655 (clone TuK4), anti-CD20-QDot 655 (clone 3G8), anti-CD8-QDot 705 (clone 3B5)(Invitrogen, Carlsbad, Calif.), anti-CD4-APC-Cy7 (clone OKT4) (Biolegend), anti-CD95-PE-Cy5 (clone DX2), and anti-CD28-Texas Red (clone CD28.2, Beckman Coulter, Fullerton, Calif.) for 30 min at RT. After fixation and permeabilization with Cytofix/Cytoperm (BD Biosciences, San Jose, Calif.) for 20 min at RT, cells were stained with anti-IFN-γ-APC (clone B27), anti-IL-2-PE (clone MQ1-17H12), anti-TNF-α-Alexa 700 (clone MAb11, R&D System) and anti-CD3-Pacific Blue (clone SP34-2) for 1 hr at room temperature. Cells were washed once, fixed with 1% PFA, and then analyzed by FACS using LSRII (BD Biosciences, San Jose, Calif.) and DiVa software. Flow cytometric acquisition and analysis of samples was performed on at least 400,000 events. Post-acquisition analyses were performed with FlowJo (TreeStar, Ashland, Oreg.). Data shown on graphs represent values of Gag or Env peptide-stimulated wells from which background values were subtracted. Polyfunctionality graphs were generated using SPICE v5.1 software (NIH, Bethesda Md.). Single color controls used CompBeads. Anti-Mouse Igκ (BD Biosciences, San Jose, Calif.) were used for compensation. Unless otherwise noted, antibodies were purchased from BD (BD Biosciences, San Jose, Calif.).

Statistical Analysis

Differences in SIV acquisition and decline of viral loads were determined by Mantel-Cox test. Normality of data was determined by D'Agostino & Pearson omnibus normality test. Data that failed the normality test were analyzed by non-parametric tests, such as Wilcoxon-Mann-Whitney test for two groups comparison or Kruskal-Wallis test with Dunn correction for multiple comparisons. In detail, differences in viral loads and set point viral loads were determined by Kruskal-Wallis test with Dunn correction. Differences in integration and the relationship of integration with various other parameters were tested by 2-way Anova or multiple t-tests both with Holm-Sidak correction. Differences in Ab titers and T cell responses between the groups at various time points were determined by Wilcoxon-Mann-Whitney test. Differences in T cell functions between before and after challenge were analyzed by SPICE software by Wilcoxon sign rank tests. Correlations were determined using Spearman correlation with Bonferroni correction of p-values. For correlations adjusted p-values are shown within the text, figures show unadjusted p-values. Analyses were conducted using GraphPad Prism 6, SAS 9.2, and SPICE v5.1.

The results of the experiments are now described in the following examples.

SIV Acquisition, Viral Loads, and Levels of SIV Integration in the Different Vaccine Groups.

Figure 9:
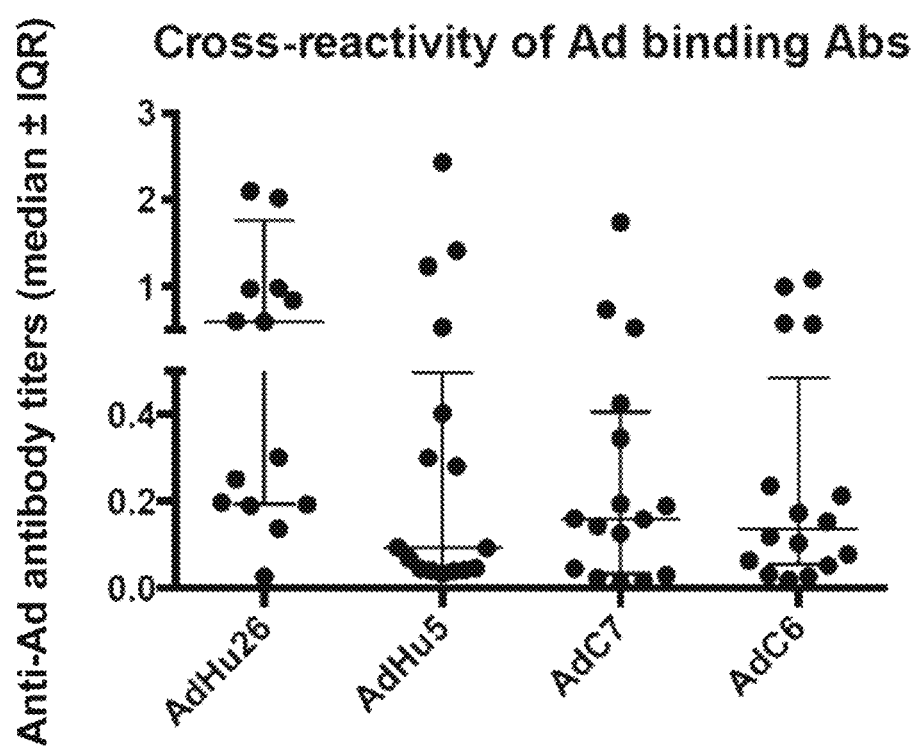
Figures 10A, 10B, 10C, 10D:
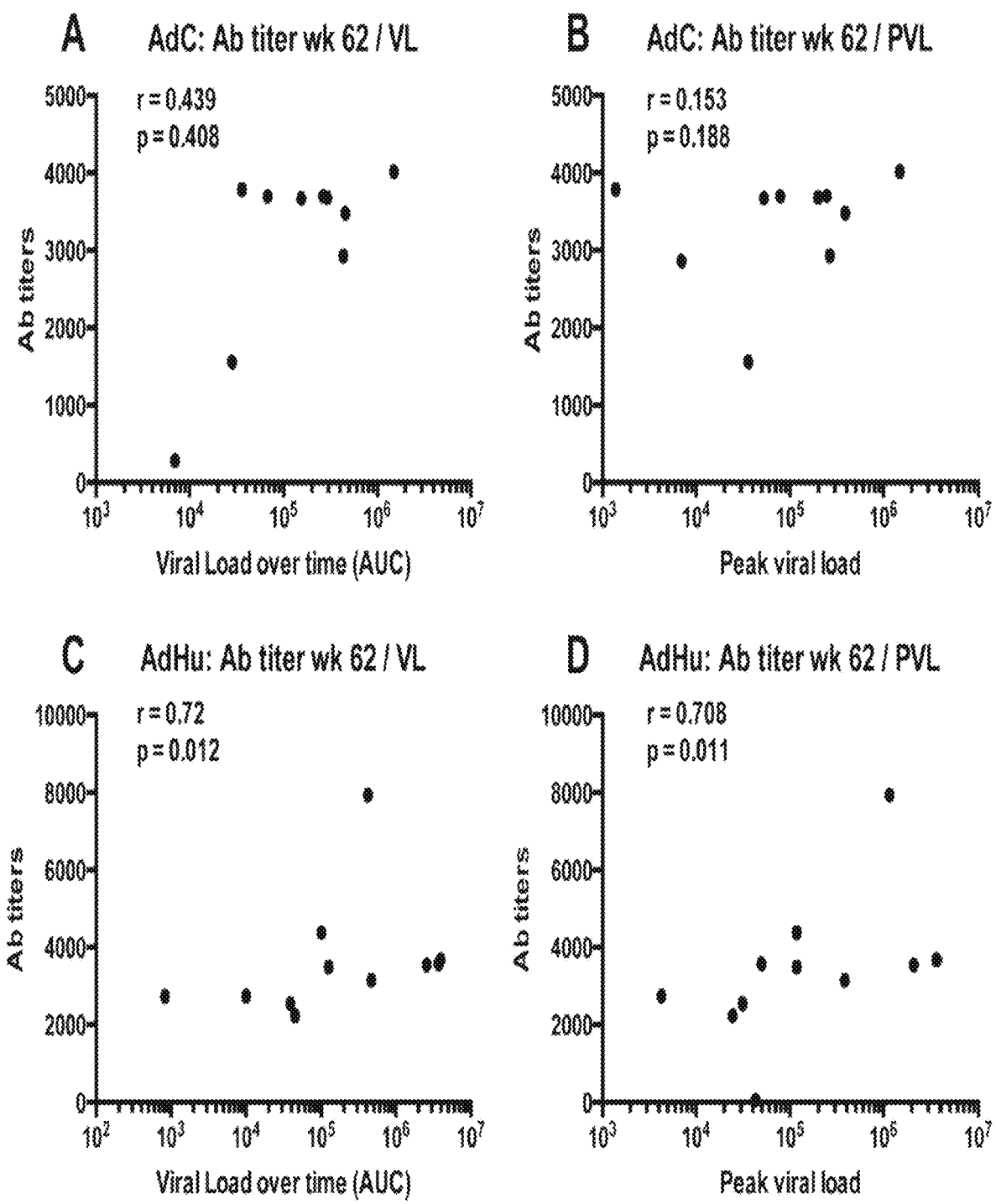

Protection from $SIV_{mac251}$ acquisition or virus replication was tested in Rhesus Macaques (RMs) immunized with Ad vectors expressing Gag and gp160 of $SIV_{mac239}$. First to more closely mimic the immune status of humans, AdHu26 and AdHu5 vectors expressing an irrelevant transgene was intra-tracheally administered to 36 healthy Indian-origin RMs. Although this procedure does not fully recapitulate the repeated infections with different Ad serotypes that humans experience during their lifetime it achieves induction of serotype-specific neutralizing (n)Abs as well as non-neutralizing Abs. Most RMs developed moderate nAb titers to AdHu5 and markedly higher titers to AdHu26 (FIG. 3). Non-neutralizing Ad-specific Abs tested in some animals after AdHu administration cross-reacted with SAd-V24, from hereinafter referred to as AdC7 and SAd-V23, from hereinafter referred to as AdC6 (FIG. 9). Animals were distributed with high or low nAb responses to AdHu5 and AdHu26 equally into three groups of twelve RMs each. Each group had eight Mamu-A*01$^+$ RMs and groups 1 and 3 each had one Mamu-B*17$^+$ animal (FIG. 3). Animals of group 1 were vaccinated four weeks after the last AdHu pre-exposure with $5\times10^{10}$ vp of AdC7 expressing Gag (AdC7gag) mixed with $5\times10^{10}$ vp of AdC7 expressing gp160 (AdC7gp160). RMs of group 2 were vaccinated with the same doses of AdHu26 vectors expressing the same inserts. RMs of group 3 were not vaccinated and served as controls. Six months after the first vaccine dose RMs of groups 1 and 2 were boosted with AdC6 and AdHu5 vectors, respectively, expressing the same inserts and used at the same doses as for priming. Starting six months after the boost, RMs were challenged rectally in weekly intervals for up to ten times with a low infectious dose (1 mean tissue infective dose) of $SIV_{mac251}$ (kindly provided by N. Miller, NIAID). RMs that developed viral loads above 1,000 RNA copies per ml of plasma received no further challenges.

Figure 4A:
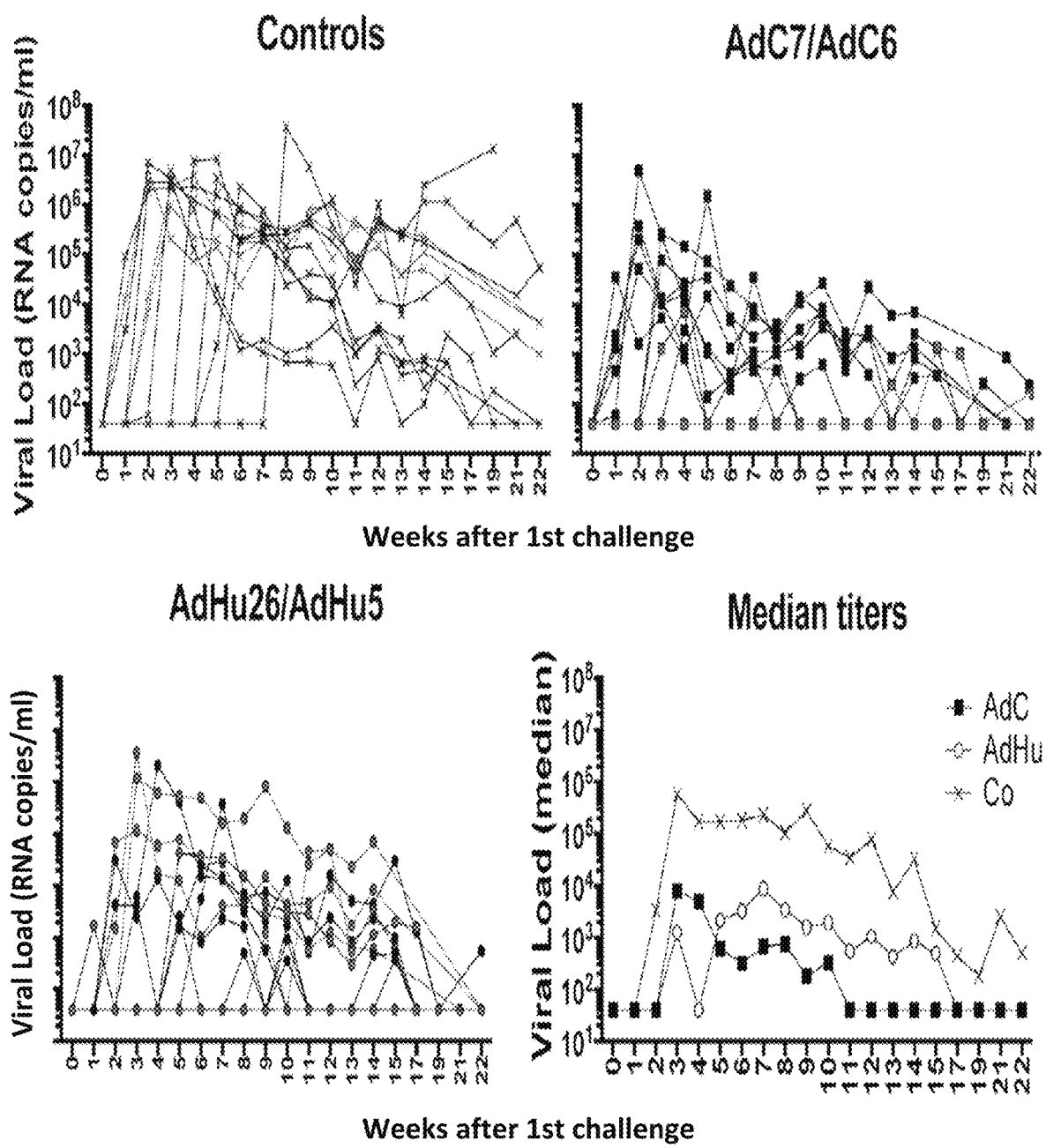
Figure 4B:
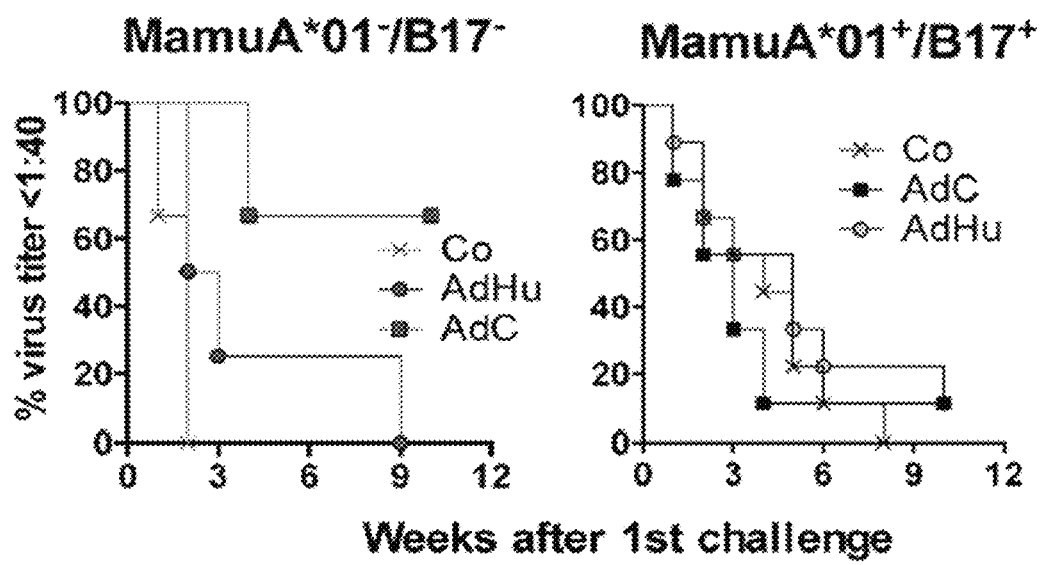

All of the Mamu-A*01$^-$/B17$^-$ control RMs became infected within two challenges (FIG. 4A). Virus acquisition was slightly delayed in AdHu-vaccinated RMs, which on average became infected by the fourth challenge; this level of protection was not statistically significant when compared to control animals. In contrast, the AdC-vaccinated Mamu-A*01$^-$/B17$^-$ RMs showed significant protection against $SIV_{mac251}$ acquisition when compared to control animals (p=0.0295 by Mantel-Cox test). Measurement of virus replication also showed significantly lower set-point viral loads (adjusted [adj.] p=0.0209 by Kruskal-Wallis test with Dunn correction) and peak viral loads (adj. p=0.0209) in Mamu-A*01$^-$/B*17$^-$ RMs of the AdC but not the AdHu vaccine group as compared to controls (FIG. 4B). Mamu-A*01$^+$/B*17$^+$ as compared to MamuA*01$^-$/B17$^-$ control RMs showed insignificant (p=0.086) increases in resistance to infection with median SIV acquisition after four challenges. On average, AdC- and AdHu-vaccinated Mamu-A*01$^+$/B*17$^+$ animals became infected after the third or fifth challenges respectively, which was not significantly different from acquisition rates of control RMs. Both Mamu-A*01$^+$/B*17$^+$ vaccine groups developed lower peak viral loads (AdC: p=0.0053, AdHu: p=0.0007) and set-point viral loads (AdC: adj p=0.0019, AdHu: adj p=0.0003) compared to controls. Interestingly all RMs with break-through infections in either of the two vaccine groups regardless of their Mamu genotype controlled viral loads to levels below 1000 copies per ml within a few weeks after the initial SIV acquisition and by 18 weeks after the first challenge all but 2 of the vaccinated RMs (one in each vaccine group) had viral loads below the level of detection. Six of the 12 control animals also showed loss of detectable viral loads although, unlike in the vaccine groups, this was only seen in unvaccinated RMs with controller genotypes. Differences in decline of viral loads were significant comparing controls to AdC (p=0.0277) or AdHu (p=0.0213) vaccinated RMs. Pre-existing nAb titers to AdHu5 or AdHu26 did not affect peak viral loads, set-point viral loads, number of challenges until infection or time until viral control in either vaccine group.

Figure 4C:
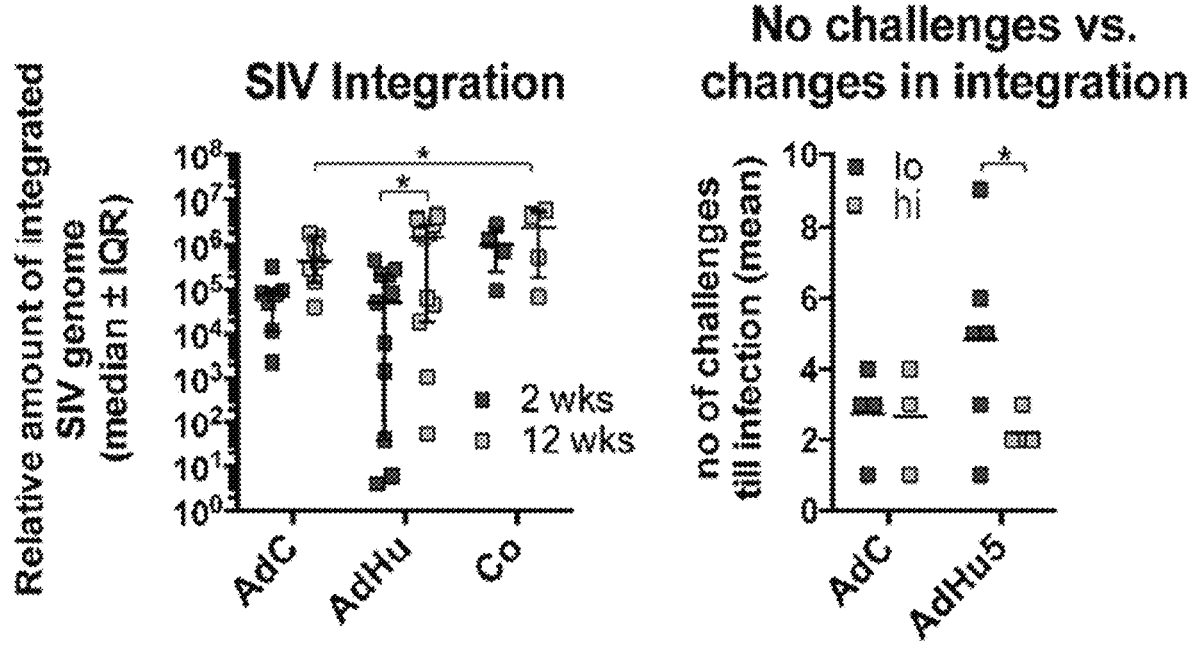

Relative amounts of integrated SIV were tested at two and twelve weeks after infection in a subset of RMs (n=7 [AdC], =11 [AdHu], =4 ([Co]) (FIG. 4C). The one tested animal that did not show detectable viral load at any time after the ten challenges was found to be negative for integrated SIV genome. Detectable levels of integrated SIV genome were found by two weeks after infection in isolated CD4$^+$ of all RMs with at least one time-point of detectable viremia, with a tendency to increase when tested again at 12 weeks after infection. This increase reached significance for the AdHu group (p=0.015). Of note, at week 12 after infection the relative amounts of integrated SIV in CD4$^+$ T cells were significantly lower in AdC-vaccinated than in control RMs (p=0.016). In the AdHu group of SIV-infected RMs, the animals that maintained relatively stable levels of integrated SIV (i.e., change below 10 fold) became infected at a later time point as compared to those that showed pronounced increases (>100 fold) during this period (p=0.03). Levels of virus integration or their changes over time were not affected by peak viral loads, time to control, Mamu genotype, pre-existing antibody titers to the AdHu vectors or antibody titers to Env.

Antibody Responses Upon Vaccination and Challenge

Figures 5A, 5B, 5C:
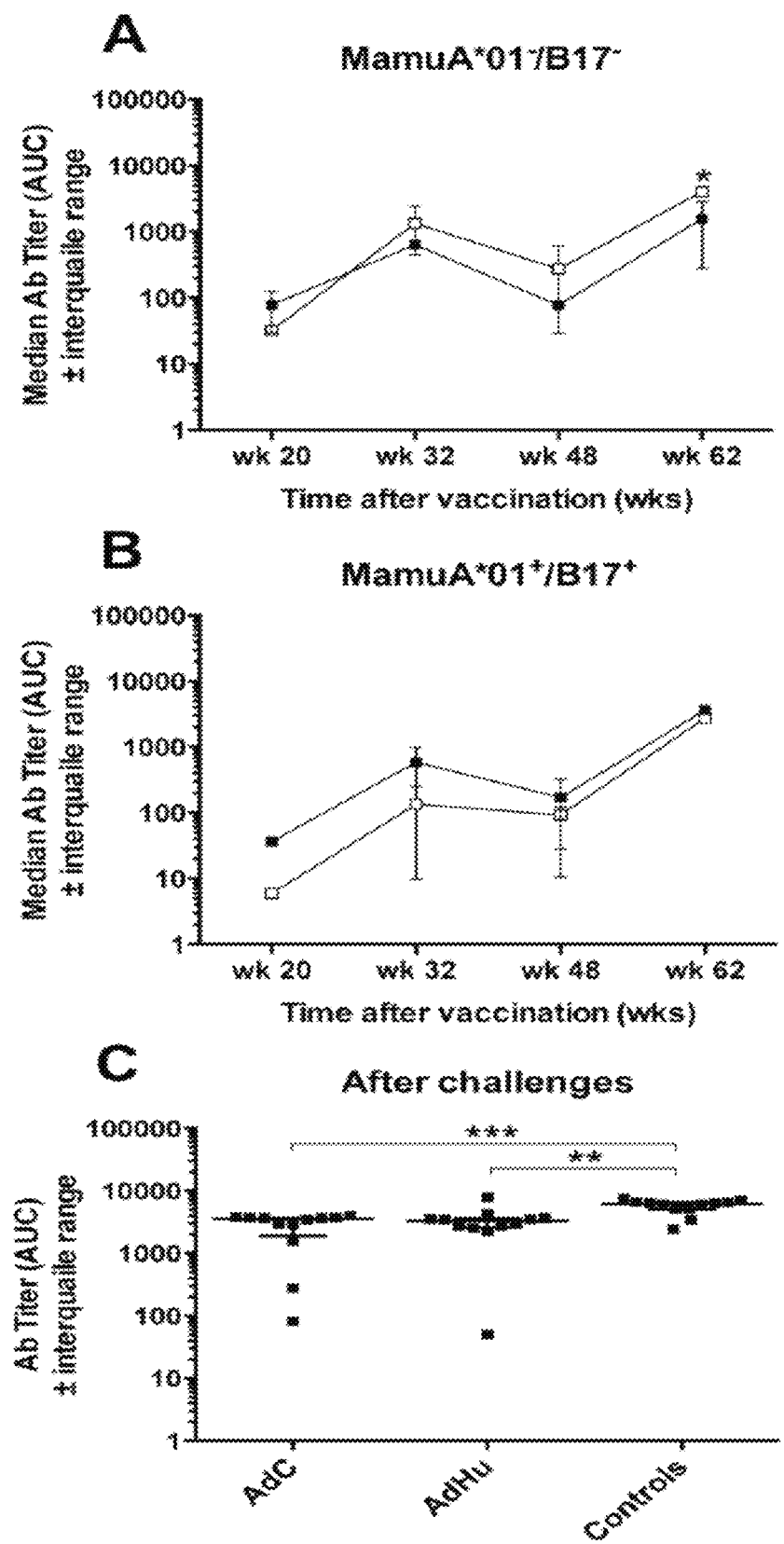
Figures 6A, 6B:
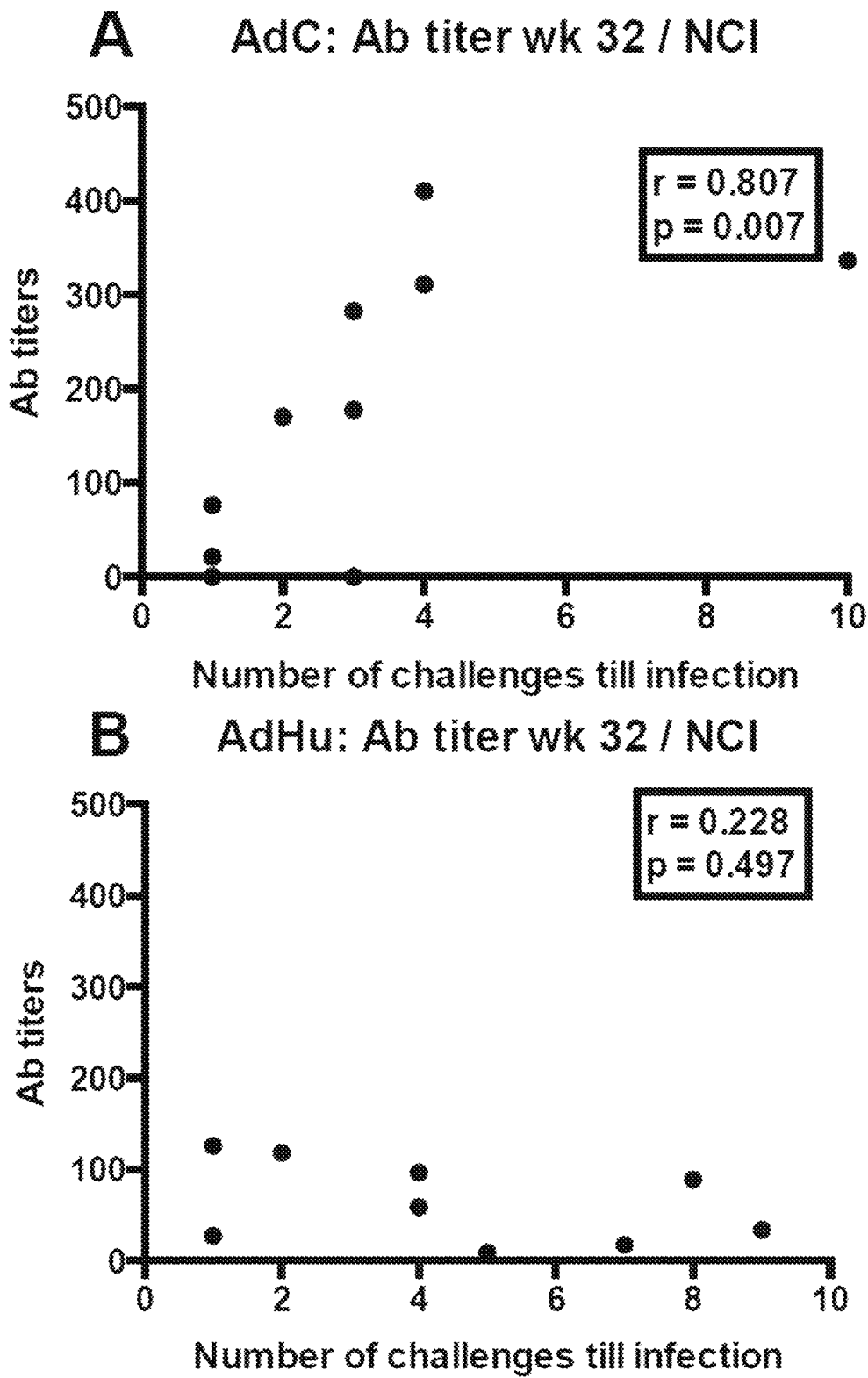
Figures 7A, 7B, 7C, 7D:
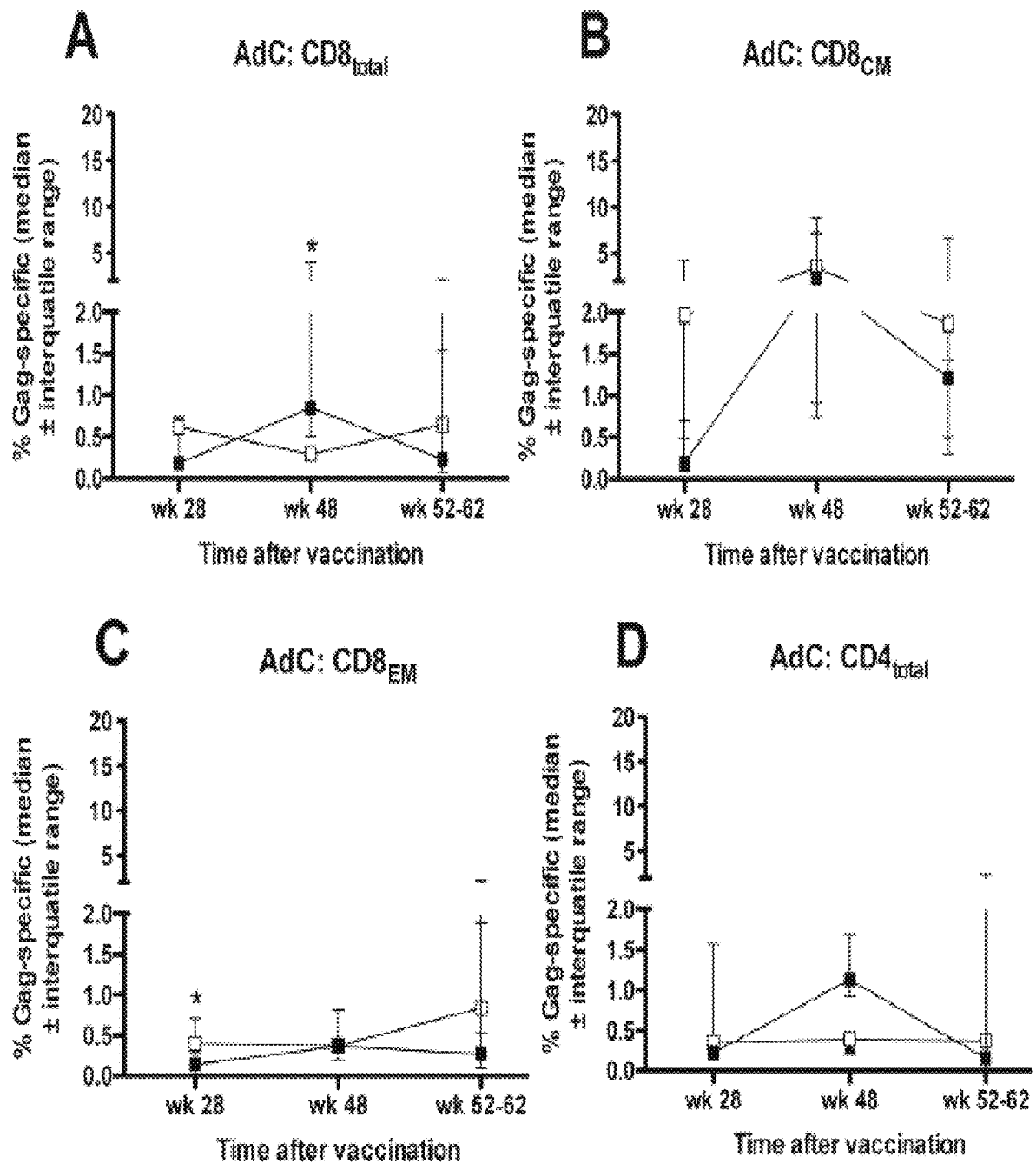
Figures 7E, 7F, 7G, 7H:
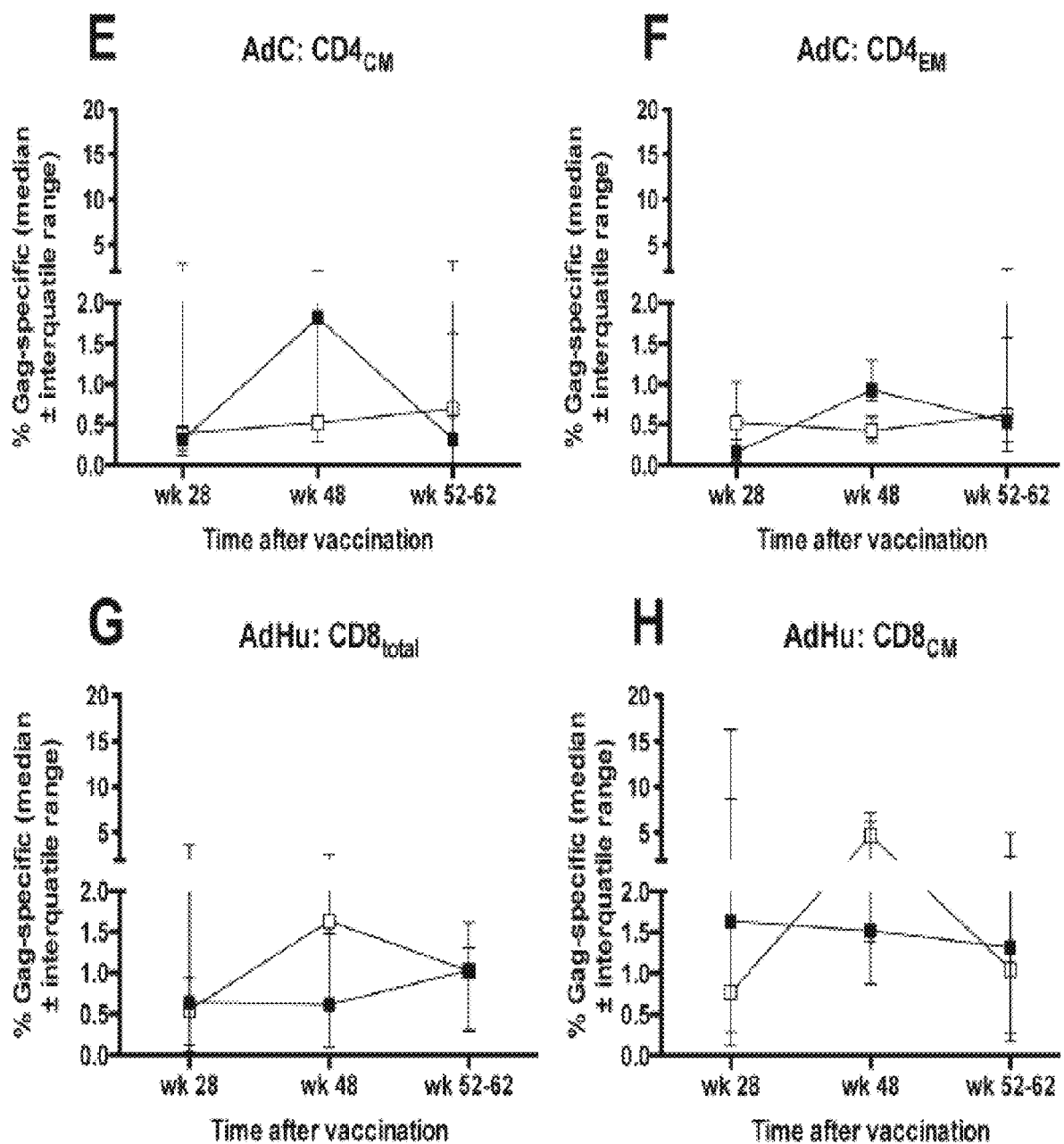
Figures 7I, 7J, 7K, 7L:
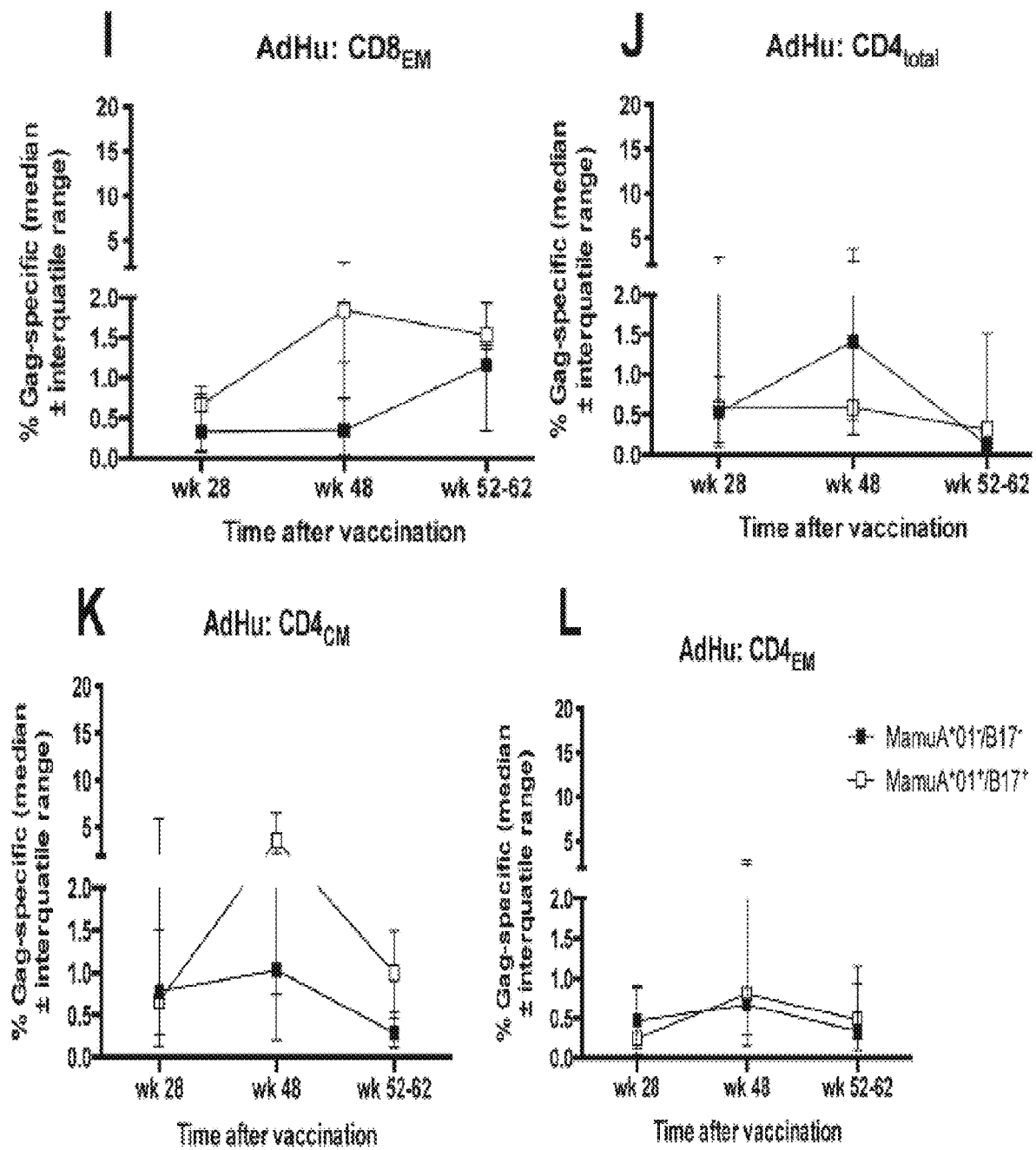

To identify correlates of immunological protection conferred by the used vaccine vectors, vaccine-induced SIV-specific immune responses were retrospectively assessed before and after challenges. In all of the vaccinated RMs Env-specific Ab responses were low after priming, increased after the boost and then contracted by the time of challenges (FIGS. 5A-5B). After challenges, vaccinated RMs that did not develop detectable viral loads failed to show increases in Env-specific Ab titers, suggesting true sterilizing immunity. All other vaccinated RMs showed pronounced increases in Ab titers after challenges (FIGS. 5A-5B). In the Mamu-$A*01^-/B*17^-$ groups, AdHu-vaccinated RMs developed significantly higher titers of SIV Env-specific Abs compared to AdC-vaccinated animals (p=0.0003 by Mann-Whitney) following infection. This most likely reflects the fact that AdC-vaccinated animals of this subcohort failed to acquire the virus or very rapidly controlled viral loads and thereby lacked sufficiently high levels of antigen to optimally increase Env-specific Ab titers. For the same reason Mamu-$A*01^+/B*17^+$ AdC-vaccinated RMs developed higher Ab titers compared to Mamu-$A*01^-/B*17^-$ RMs (p=0.0006) after challenges. In AdC- but not AdHu-vaccinated RMs (analyzing all animals together regardless of the Mamu genotype), Ab titers after the boost directly correlated with numbers of challenges required to achieve infection (r=0.807, adj. p=0.0278 by Spearman correlation, FIGS. 6A-6B). In the AdHu5 group, correlations were only seen for Ab titers after challenges and set-point viral loads (r=0.720, adj. p=0.0425) and peak viral loads (r=0.708, adj. p=0.0494, FIGS. 10A-10D). Control RMs developed robust Ab titers after challenges (FIG. 7C), which were higher than in vaccinated animals with breakthrough infections (AdC: adj. p=0.003, AdHu: adj. p=0.0068). Pre-existing Ab titers to either AdHu5 or AdHu26 had no significant effect on Ab responses in the two vaccine groups. Finally binding Abs directed against the V1/V2 loop, which have been linked to protection in humans and RMs (Zolla-Pazner et al., PLoS One. 8, e53629 (2013); Barouch et al., Nature. 482, 89-93 (2012)), were not detected until after challenges. There were no associations between antibody titers at any of the tested time points and levels of SIV integration.

T Cell Responses Upon Vaccination and Challenge

Figure 11:
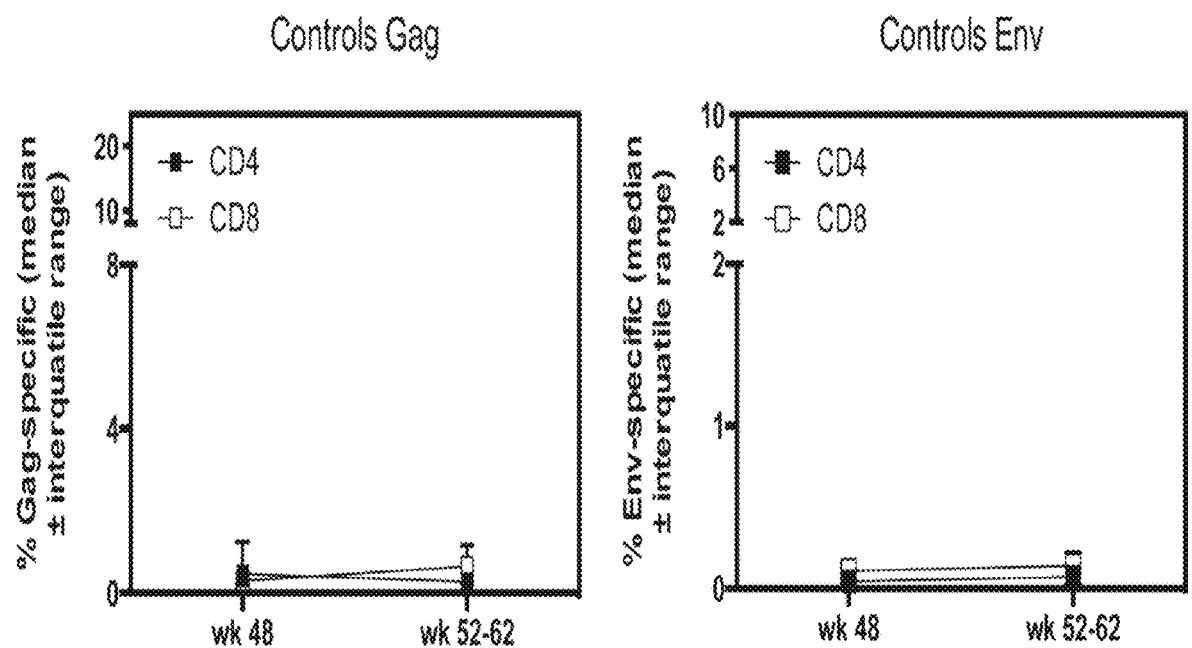
Figures 12A, 12B:
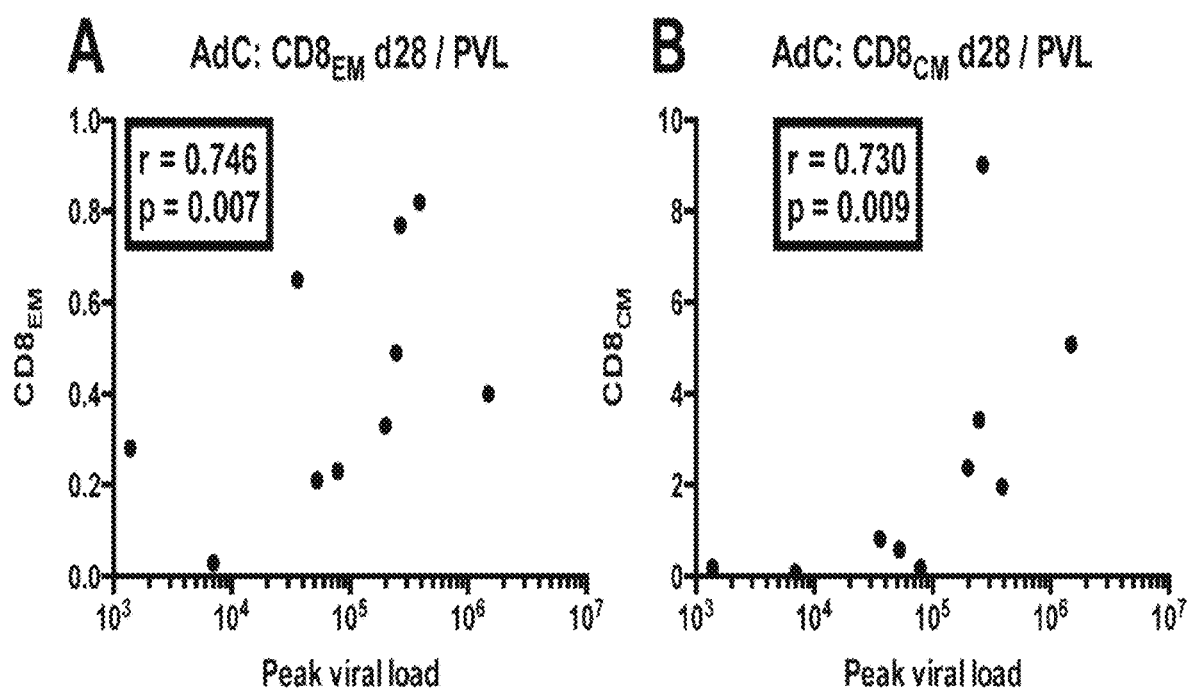
Figures 12C, 12D, 12E, 12F:
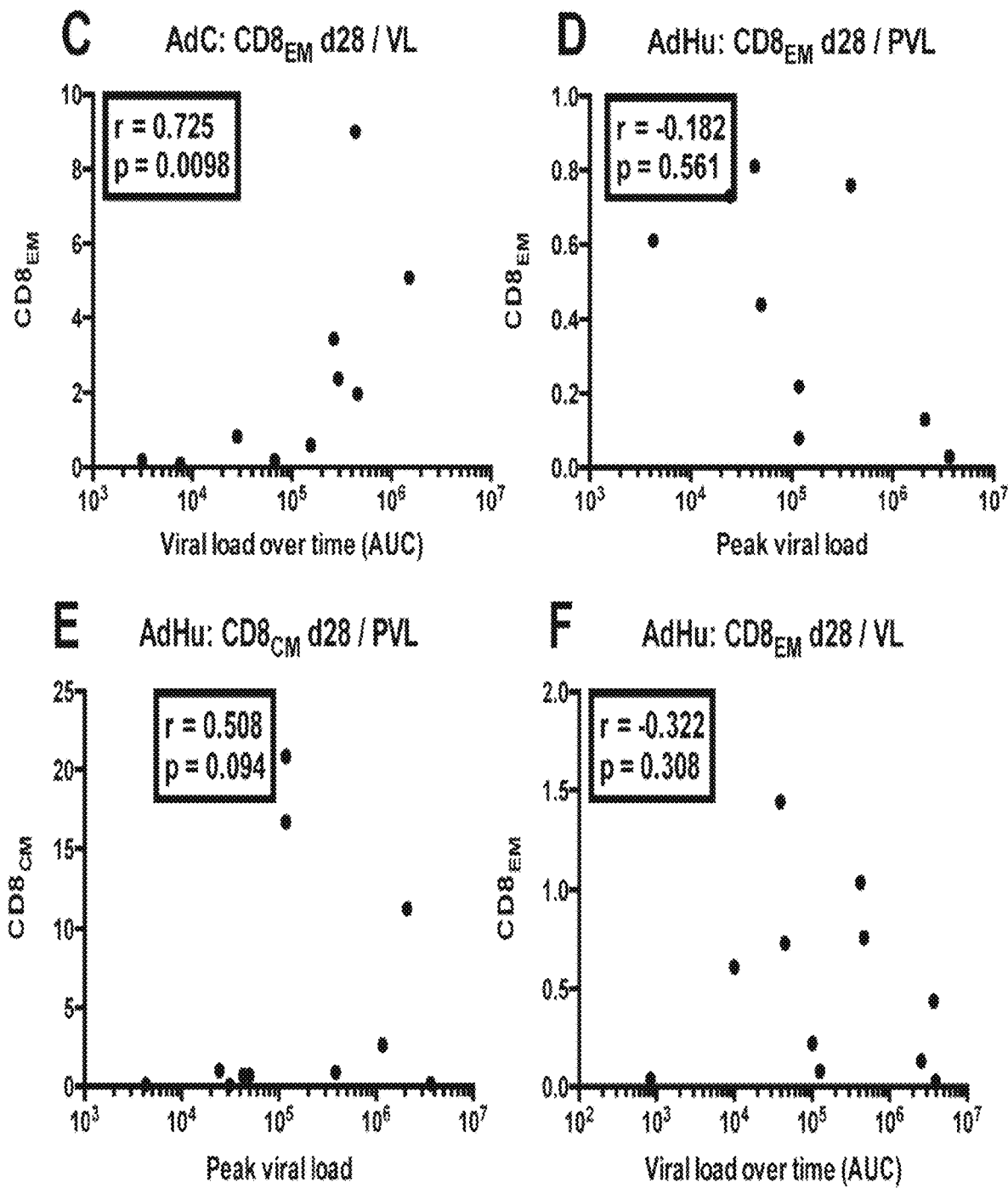
Figures 13A, 13B, 13C, 13D:
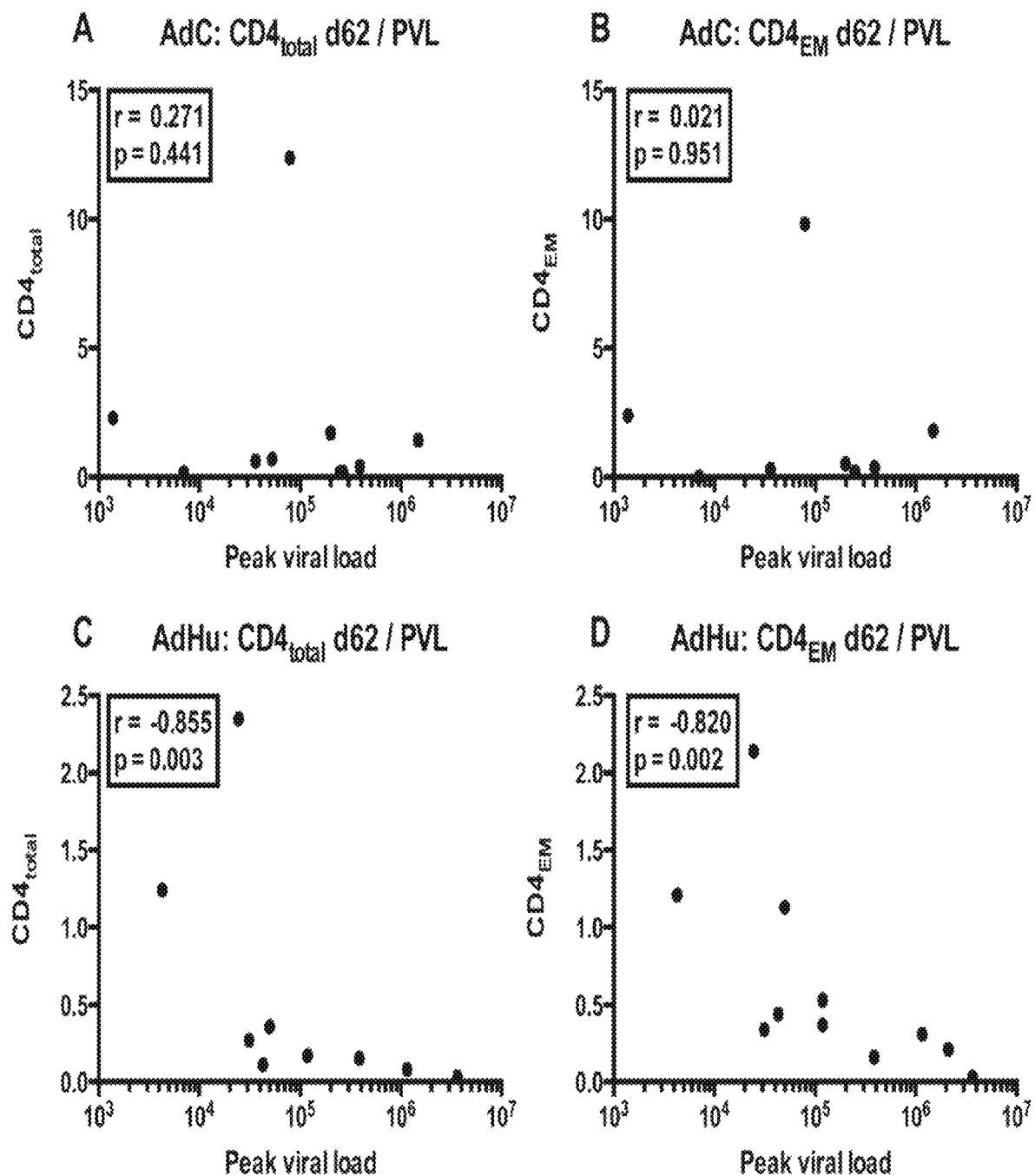
Figure 14:
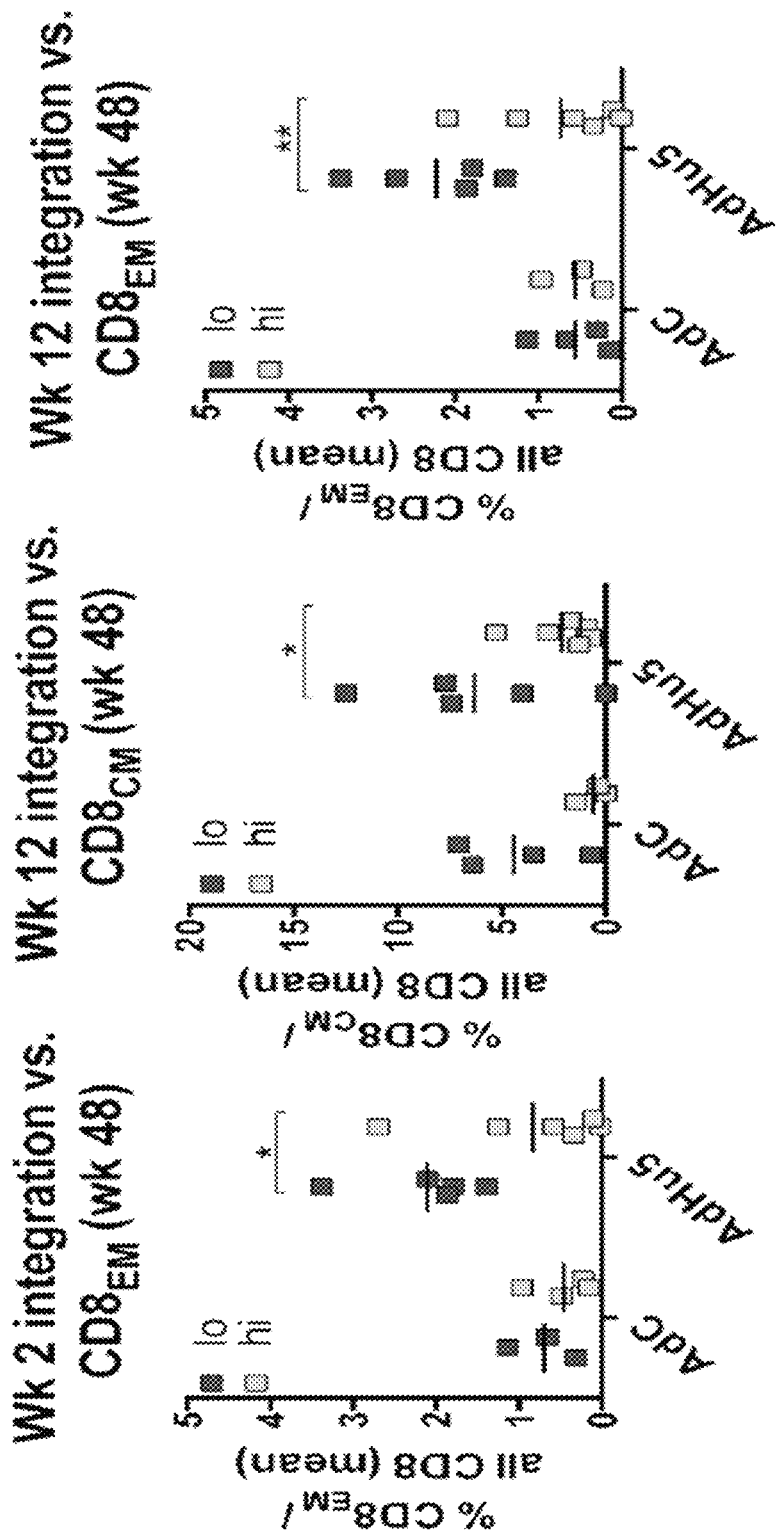
Figures 15A, 15B, 15C, 15D:
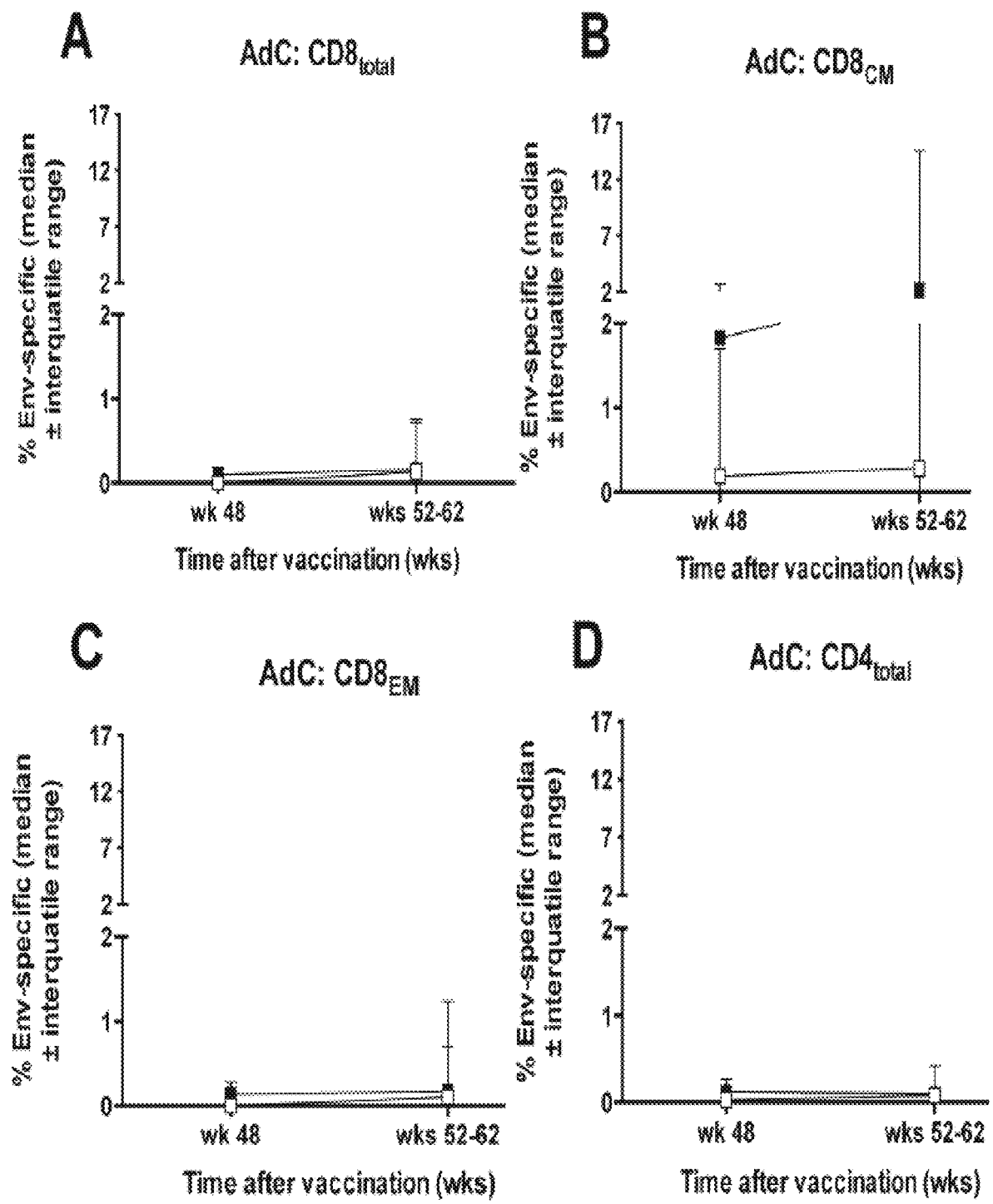
Figures 15E, 15F, 15G, 15H:
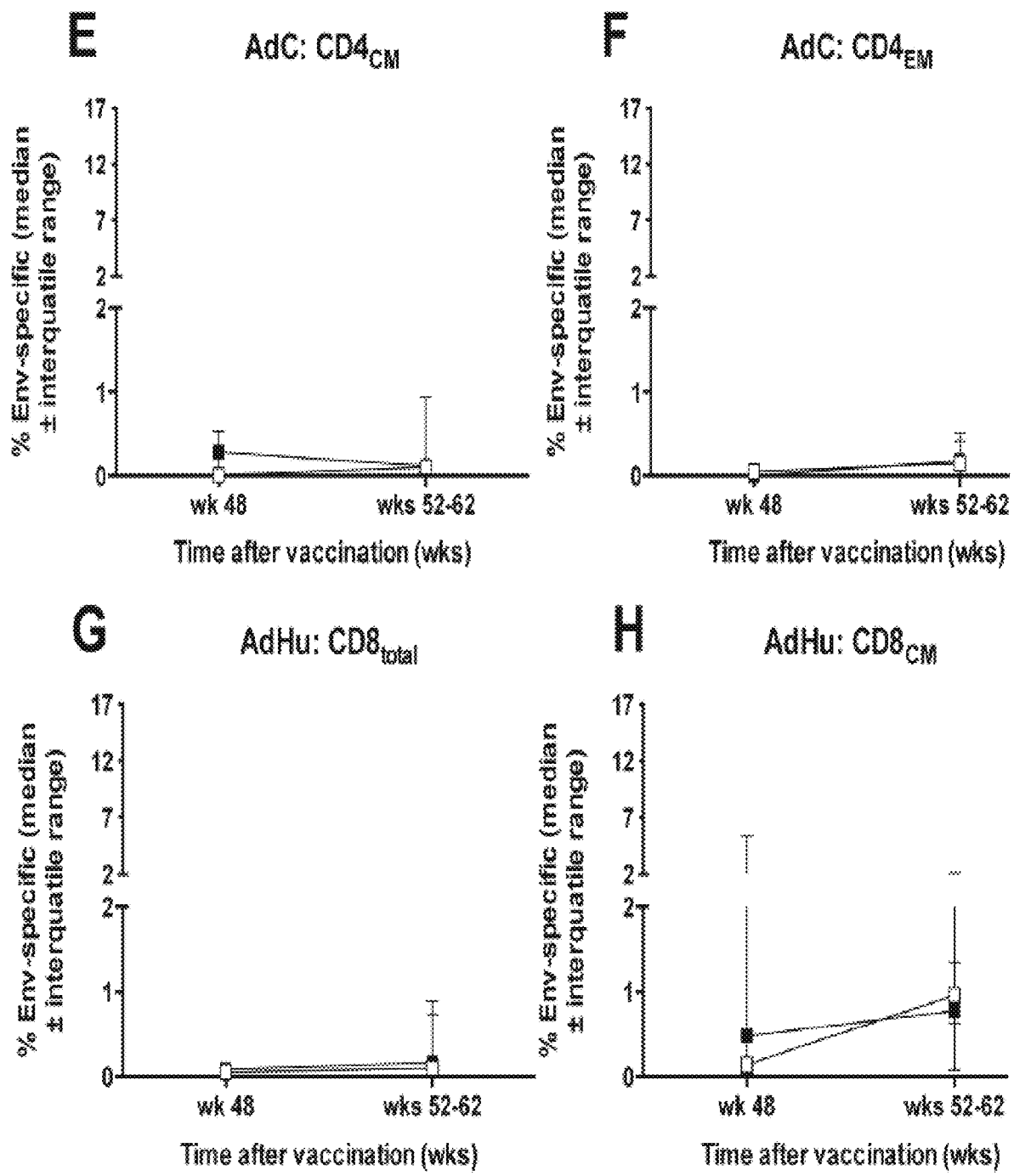
Figures 15I, 15J, 15K, 15L:
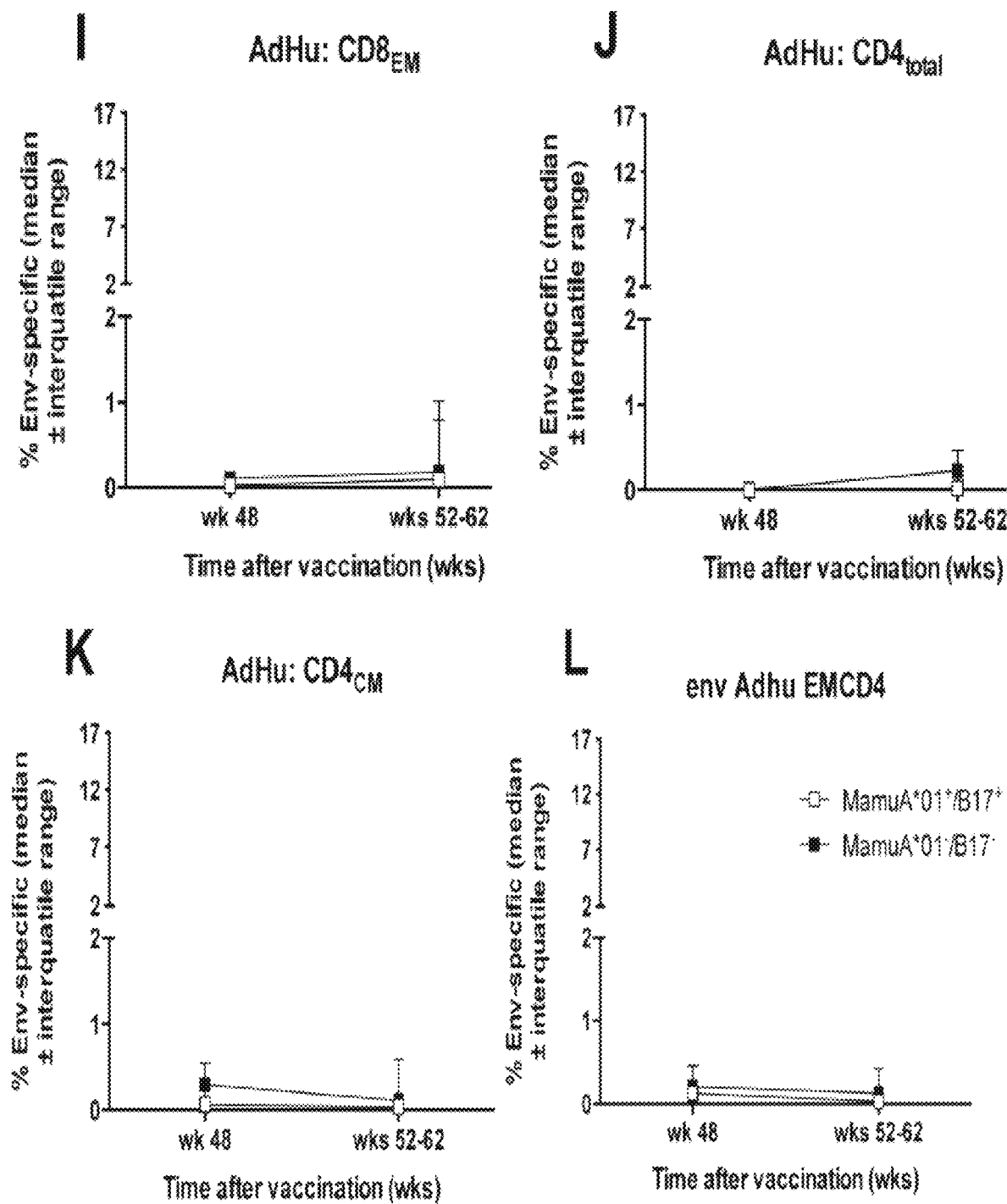

Total T cell responses to Gag were measured by intracellular cytokine staining and multicolor flow cytometry in AdC- and AdHu-vaccinated (FIGS. 7A-7L) and control RMs (FIG. 11) as the fraction of CD4$^+$ or CD8$^+$ T cells showing at least one functional responses (i.e., production of IFNγ, IL-2, or TNF, or surface expression of the degranulation marker CD107). Both vaccine regimens induced total Gag-specific T cells responses of comparable magnitude. The only significant difference in T cell responses between animals with or without controller genotypes was seen in the AdC group (FIG. 7A), where the better protected Mamu-$A*01^-/B*17^-$ RMs had significantly higher total Gag-specific CD8$^+$ cell responses (p=0.042 by Wilcoxon-Mann-Whitney test) at the time of first challenge. In the AdC but not the AdHu vaccine group Gag-specific effector memory ($CD8_{EM}$) (FIGS. 12A-12F) and central memory ($CD8_{CM}$) (FIGS. 12B-12E) CD8$^+$ T cell responses at 4 weeks after the boost correlated with peak viral loads (CD8 cm: r=0.729, adj. p=0.036, $CD8_{EM}$: r=0.746, adj. p=0.0359); $CD8_{EM}$ responses measured shortly after the boost also correlated with set-point viral loads (r=0.725, adj. p=0.0392) (FIGS. 12C-12E). In the AdHu vaccine group correlations for CD8$^+$ T cells were only seen in Mamu-$A*01^-/B*17^-$ RMs; frequencies of total Gag-specific CD8$^+$ and $CD8_{EM}$ cells at the day of challenges showed inverse correlations with time to viral controls (for both r=−0.9487, adj. p<0.0001). In the same group unlike in AdC-vaccinated RMs total Gag-specific CD4$^+$ T cells (FIG. 13A and FIG. 13C) and $CD4_{EM}$ cells (FIG. 13B and FIG. 13D) after challenges inversely correlated with peak viral loads (total CD4 r=−0.845, adj. p=0.011, $CD8_{EM}$: r=−0.82, adj. p=0.0064). In the AdHu5 group RMs with lower levels of SIV integration by 2 weeks after infection (<50,000) had higher frequencies of Gag-specific $CD8_{EM}$ T cells responses before challenge than those with higher levels of integration (p=0.016), while in the same group animals with low levels of integrated virus by week twelve after infection (<10$^6$) had higher frequencies of Gag-specific $CD8_{CM}$ (p=0.003) and $CD8_{EM}$ T cells (p=0.037) before challenge (FIG. 14). Env-specific T cell responses, including those of subsets were low and comparable between the vaccine groups and between Mamu-$A*01^+$/B17$^+$ and Mamu-$A*01^-$/B17$^-$ RMs (FIGS. 15A-15L).

Figure 16:
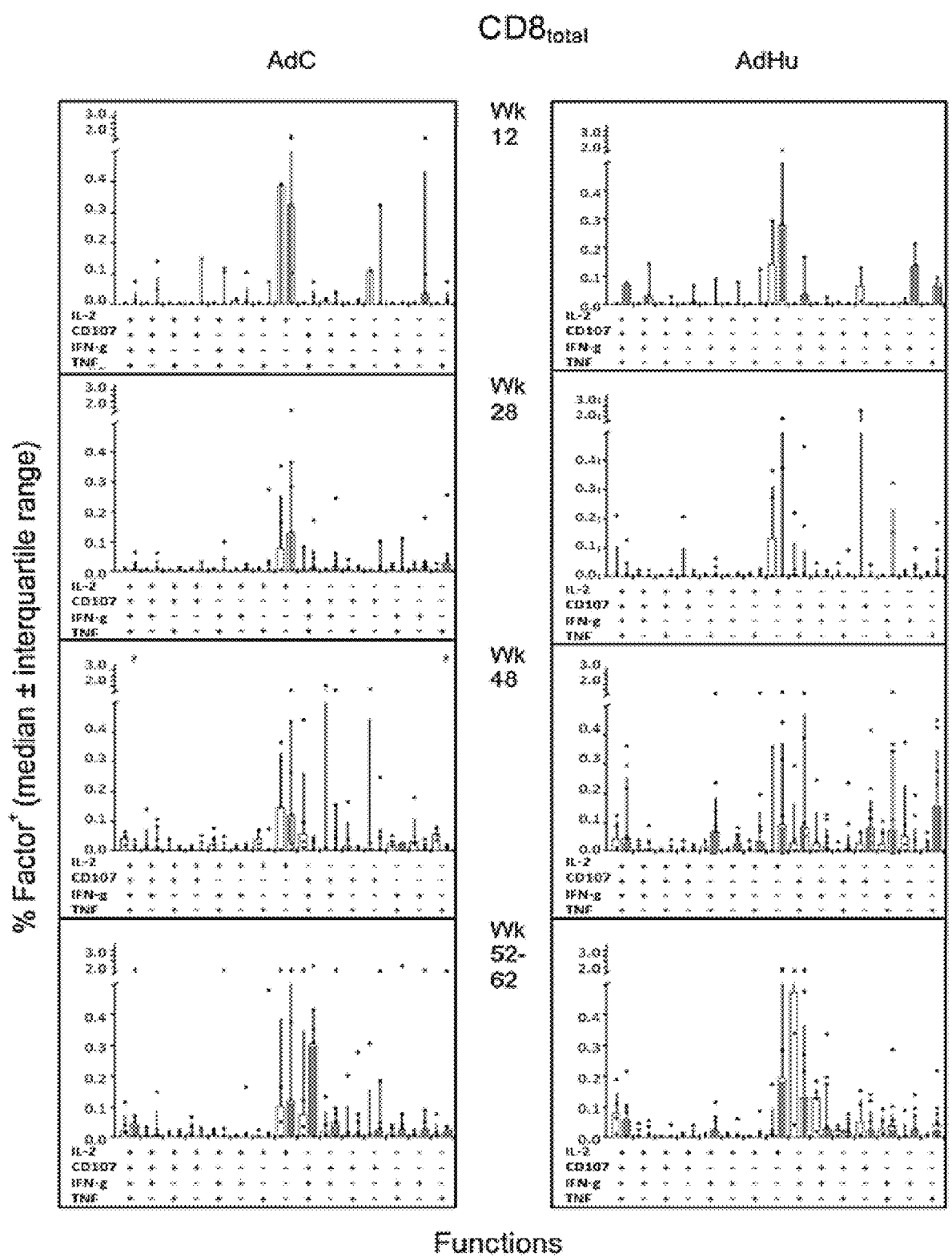
Figure 17:
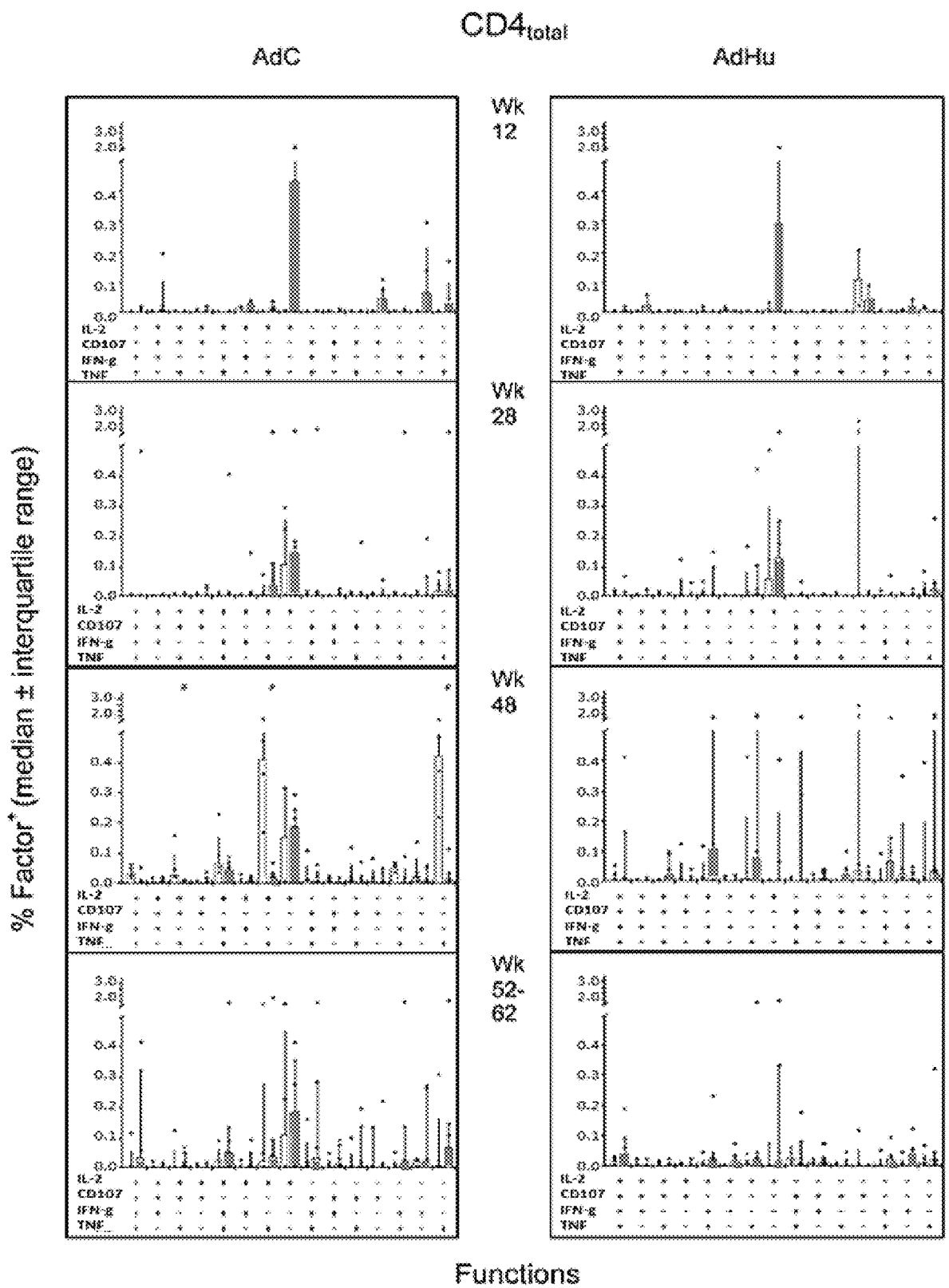
Figure 18:
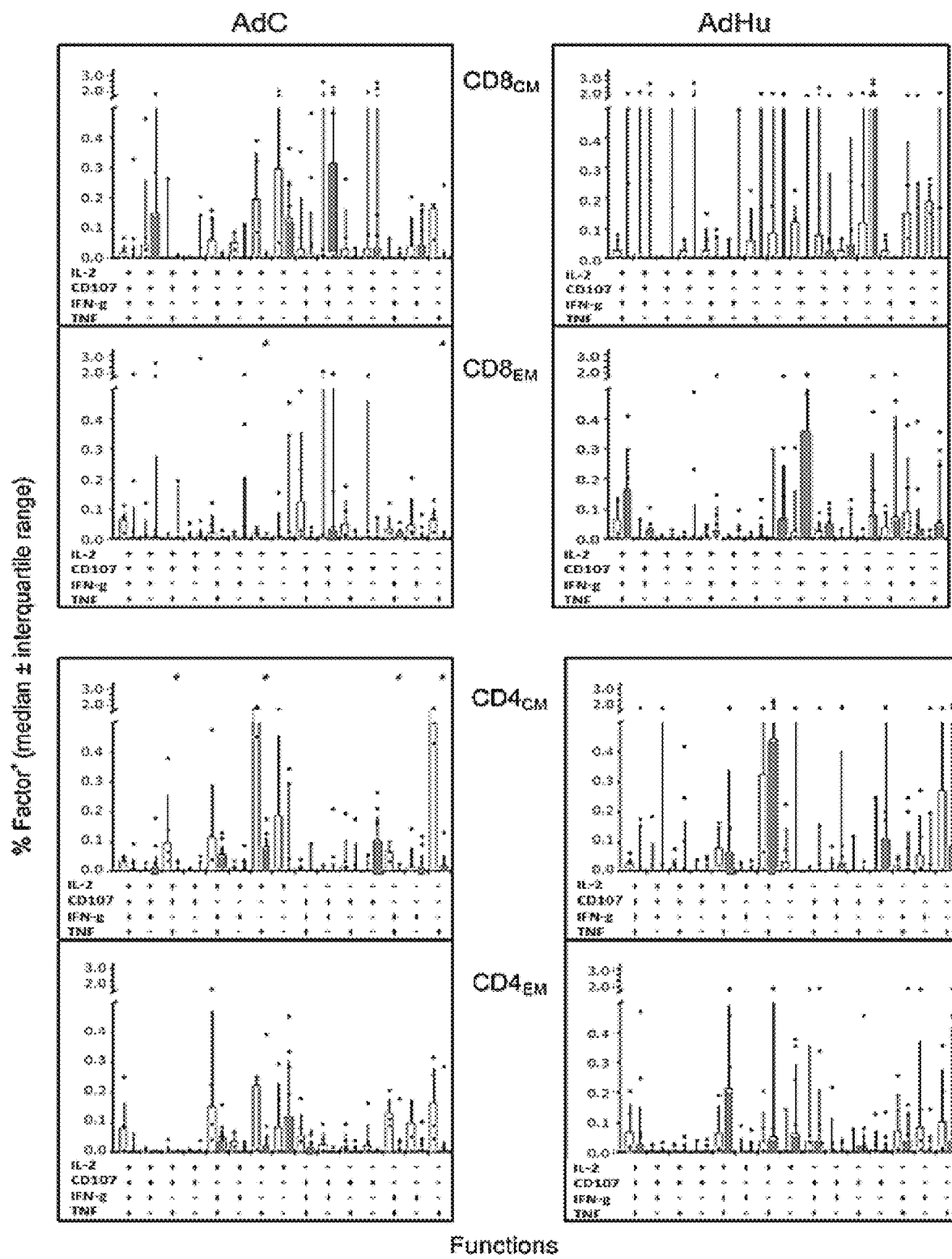

Gag-specific CD8$^+$ T cells were also specifically analyzed for each individual function, i.e., production of IL-2, IFN-γ, TNF-α and degranulation of CD107 in response to SIV-Gag peptides. Functionality of virus-specific CD8$^+$ T cells between the vaccine groups and within the vaccine groups between Mamu-$A*01^+$/B17$^+$ and Mamu-$A*01^-$/B17$^-$ RMs were largely comparable at the different time points tested (FIG. 16). After priming, CD8$^+$ T cell responses were dominated by cells producing IL-2, and after. The boost responses became more polyfunctional with this trend becoming even more pronounced after challenges. Differences between the two vaccine groups were seen shortly before challenges when animals of the AdHu vaccine groups had higher frequencies of CD8$^+$ T cells that exhibited all 4 functions (p=0.016 by Wilcoxon Rank test) or produced TNF-α only (p=0.026). After priming CD4$^+$ T cell responses of AdC- and AdHu-vaccinated RMs were dominated by cells producing IL-2 only (FIG. 17). After the boost, responses again became more polyfunctional and IFN-γ only producing CD4$^+$ T cells became dominant in the AdHu group. Differences between AdC-vaccinated animals with or without controller genotypes were seen just prior to the first challenge when Mamu-$A*01^-$/B17$^-$ RMs had higher frequencies of Gag-specific CD4$^+$ T cells positive for IL-2, CD107a and TNF-α (p=0.021), IL-2 and TNF-α (p=0.021) or TNF-α only (p=0.021). Responses of AdHu-vaccinated animals were not significantly affected by controller genotypes. Pre-existing nAbs to AdHu5 vectors did not affect the magnitude or functions of Gag-specific CD8$^+$ or CD4$^+$ T cell responses in either vaccine group. An analysis of Gag-specific T cell subsets just prior to challenges revealed in general comparable functions between the vaccine groups or between Mamu-$A*01^-$/B17$^-$ and Mamu-$A*01^+$/B17$^+$ RMs in either vaccine group (FIG. 18). Differences were seen mainly for $CD4_{CM}$ of AdC-vaccinated RMs; those that were Mamu-$A*01^-$/B*17$^-$ showed higher frequencies of cells positive for IL-2, CD107a, and TNF-α (p=0.013), IL-2 and TNF-α (p=0.013), IFN-γ and TNF-α (p=0.013), and TNF-α only (p=0.013).

Functional In Vivo Assessment of CD8+ T Cell Responses Through CD8+ Lymphocyte Depletion.

The antiviral role of CD8+ T cells in the context of SIV infection of RMs has been directly demonstrated in many studies that used in vivo depletion of these cells with CD8 directed antibodies as pioneered in the publication by Schmitz et al., 1999 (Schmitz et al., Science 283, 857-60 (1999)). In the current invention, the role of CD8+ T cells in protecting from SIV disease progression was directly assessed by performing CD8+ lymphocyte depletion in five AdC- and four AdHu-vaccinated RMs at 28 weeks after completion of challenges. All animals, except one RM of the AdHu vaccine group, which had remained virus-free after 10 challenges, developed detectable viral loads following CD8+ cell depletion (FIG. 8), thus confirming that control of virus replication was mediated by CD8+ lymphocytes. Once the depleting treatment was stopped and the observed number of CD8+ lymphocytes returned to the baseline (pre-depletion levels) viral loads rapidly declined in all but one of the AdC-vaccinated RMs. This animal, which did not develop viral loads above 1,000 RNA copies/ml until five weeks after the tenth challenge but was viremic at the time of CD8+ cell depletion, did not show major increases in viral loads after CD8 depletion, perhaps suggesting CD8+ T cells had become unable to control SIV replication as a result of the presence and outgrowth of escape mutants.

Overall, testing in mice and nonhuman primates showed that a prime-boost regimen using two serologically distinct AdC vectors markedly increases T and B cell responses to the transgene product (McCoy et al., J Virol. 2007; 81:6594-604; Santra et al., Vaccine. 2009; 27:5837-45; Tatsis et al., Virology. 2007; 367:156-67; Zhou et al., Mol Ther. 2010; 18:2182-9; Tatsis et al., J Immunol. 2009; 182:6587-99; Lasaro et al., Mol Ther. 2011; 19:417-26).

Example 5: Other Studies

Mice Studies

No side effects were noted in mice at intramuscular doses as high as $5 \times 10^{11}$ vp using AdC6 and AdC7 vectors with a variety of different inserts including HIV-1 gag. The highest vaccine dose tested in nonhuman primates (NHPs) for AdC6 and AdC7 vectors expressing a truncated version of HIV-1 gag or the rabies virus glycoprotein was $10^{12}$ vps. These animals also showed no overt symptoms after immunization in an experiment in which animals were primed with AdC7 vectors, boosted 8 months later with AdC6 vectors and then 4 months after that with AdHu5 vectors to assess immune responses.

Nonhuman Primate Studies

To assess vector immunogenicity and efficacy a number of nonhuman primate studies were conducted with AdC6 and AdC7 expressing a variety of inserts including, but not limited to, SIVgag, SIVenv, HIV-1env and the rabies virus glycoprotein. Although the primary endpoint of these studies was not to assess vector toxicity, all immunized animals were routinely checked for their health status. Nonhuman primate studies were conducted at three facilities (i.e. at the University of Pennsylvania, at BIOQUAL Inc. (Rockville, Md.), and at the Yerkes National Primate Research Center (Atlanta, Ga.)). NHP samples (i.e., blood and sera) were screened for Complete Blood Count with differential/absolute numbers (white blood cell counts, red blood cell counts, hemoglobin, hematocrit, mean corpuscular volume, mean corpuscular hemoglobin concentration, polymorphonuclear leukocytes, metamyelocytes, lymphocytes, monocytes, eosinophils, basophiles, and platelets) and blood chemistries (calcium, phosphorus, chloride, lactate dehydrogenase, aspartate aminotransferase, total bilirubin, gamma-glutamyl transferase, alanine aminotransferase, alkaline phosphatase, total protein, total globulin, albumin, blood urea nitrogen, creatinin, glucose, creatine kinease, and aldolase). The NHP samples did not show any abnormalities except for some small increases in liver enzymes that were sometimes observed and thought to be a reflection of anesthesia-related stress.

Example 6: Ongoing Studies

In one embodiment, the AdC6-HIVgp140 and AdC7-HIVgp140 vectors of this invention are combined with additional vaccines to enhance and broaden HIV-1-specific T and B cell responses.

Addition of an AdC6-HIVgp140 Vector Boost:

To optimize B cell responses AdC7-HIVgp140 primed individuals are boosted 6 or more months later with AdC6-HIVgp140 used at the same dose as the priming vector.

Addition of a Protein Boost:

As an alternative or in addition, subjects from the Phase 1 study receive a protein boost 12 or more months after vaccination with a single AdC Env vector vaccine or 12 or more months after the AdC6-HIVgp140 boost of AdC7-1-HIVgp140 primed individuals as described above herein. A potential protein vaccine candidate is a gp145 protein derived from an early Glade C isolate from Tanzania produced in CHO cells that is under development by the National Institute of Allergy and Infectious Diseases (NIAID).

AdC6-HIVgag and AdC7-HIVgag:

In some aspects of this invention, the inclusion of AdC vectors expressing additional HIV antigens broaden and enhance T cell responses. AdC vectors that express gag of a Glade B HIV-1 strain (AdC6-HIVgag and AdC7-HIVgag) were developed. Following the completion of the initial Phase 1 trial, additional studies with the AdC6 and AdC7 vectors containing the gag insert are pursued and followed by a study in which subjects receive all four AdC vectors.

Example 7: Vaccines Design, Construction and Characterization: AdC6 and AdC7 Vectors The vaccines of the present invention were based on recombinant viruses derived from clones of two chimpanzee adenoviruses, AdC6 and AdC7 also referred to as SAdV-23 and SAdV-24. The parent viruses were obtained from ATCC (AdC6-ATCC-VR-592, AdC7-ATCC-VR-593). The Ad genome contains five segments that encode early gene products, i.e., E1-E5, and five segments that encode five late gene products, i.e., L1-L5. The E1, E2 and E4 gene products regulate the transcription and translation of the later genes and are necessary for viral replication. The E3 gene products subvert immune responses by altering antigen presentation and cytokine and apoptosis pathways but are unnecessary for viral replication. Deletion of the E3 in addition to the E1 domain increases the permitted size of the inserted expression cassette to ~7.5 kilobases (Kb).

To generate the E1-deleted AdC6 molecular clone, the 5' right inverted terminal repeat (ITR) was amplified by Polymerase Chain Reaction (PCR) and cloned into the pNEB193 vector. Using restriction enzyme sites that are unique in assembly but not necessarily unique to the full AdC6 genome, the right half of the AdC6 genome was then cloned piecemeal into the pNEB193 vector. The left ITR was amplified by PCR and cloned into a different pNEB193 vector. Using the same strategy as above, the remainder of the left fragment of the AdC6 genome was assembled into the pNEB193 vector. Approximately 2.6 Kb of the E1 region between SnaBI and NdeI sites were omitted and replaced with a linker that contains the rare enzyme sites of I-CeuI and PI-SceI. These steps remove the entire E1a and E1b 19-kDa homolog-coding regions and 74% of the E1b 55-kDa homolog-coding region. Finally, using two suitable enzymes, the E1-deleted left fragment of AdC6 was released from the pNEB193 vector and inserted into the vector containing the right fragment of the genome, effectively generating the E1-deleted infectious molecular clone of AdC6.

To delete the E3 domain, a fragment was cut from the E1-deleted AdC6 molecular clone by digestion with SbfI. The ends of this SbfI fragment were joined by ligation and the ~4 Kb E3 region was removed from this SbfI fragment using suitable restriction enzymes, i.e., Eco47III and SwaI. The resulting E3-deleted SbfI fragment was then swapped into the E1-deleted molecular clone to replace the original SbfI fragment and generate an E1/E3-deleted AdC6 molecular clone. For AdC6-HIVgp140 viral molecular clone, which also contains a partial E3 deletion, ORF3, ORF4, ORF5, ORF6 and ORF7 of E3 were removed using similar strategy as described.

To create an E1- and E3-deleted viral molecular clone of AdC7, a similar cloning strategy was adopted. The E1-deleted AdC7 clone was generated first in the pBR322 plasmid to harbor most of AdC7 genome and both ITRs, except the E1 region. Approximately 2.6 Kb between the sites of SnaBI and NdeI were deleted to, remove E1 (nucleotide number 455 to 3028). Two sites for endonucleases I-CeuI and PI-SceI were incorporated within the deleted E1 domain to facilitate insertion of the transgene cassette. In the partially E3-deleted viral molecular clone a fragment from nucleotide number 27775 to 31298 was excised removing ORF3, ORF4, ORF5, ORF6 and ORF7 of E3.

Table 1 below illustrates the nucleotide number of the deleted portion of E1 and E3 domain (based on Genbank Accession numbers AY530877 and AY530878 that are sequences for wildtype AdC6 and AdC7 respectively) in the recombinant AdC vector described in this invention.

TABLE 1

Nucleotide Numbers of the Deleted Portion of E1 and E3 Domain in the rAdC Vectors

| Vector Name | Nucleotide Number of E1 Deleted Region* | Nucleotide Number of E3 Deleted Region* |
|---|---|---|
| AdC6-HIVgp140 | 455-3022 bp | 27835-31052 bp |
| AdC7-HIVgp140 | 455-3028 bp | 27775-31298 bp |

Figure 19B:
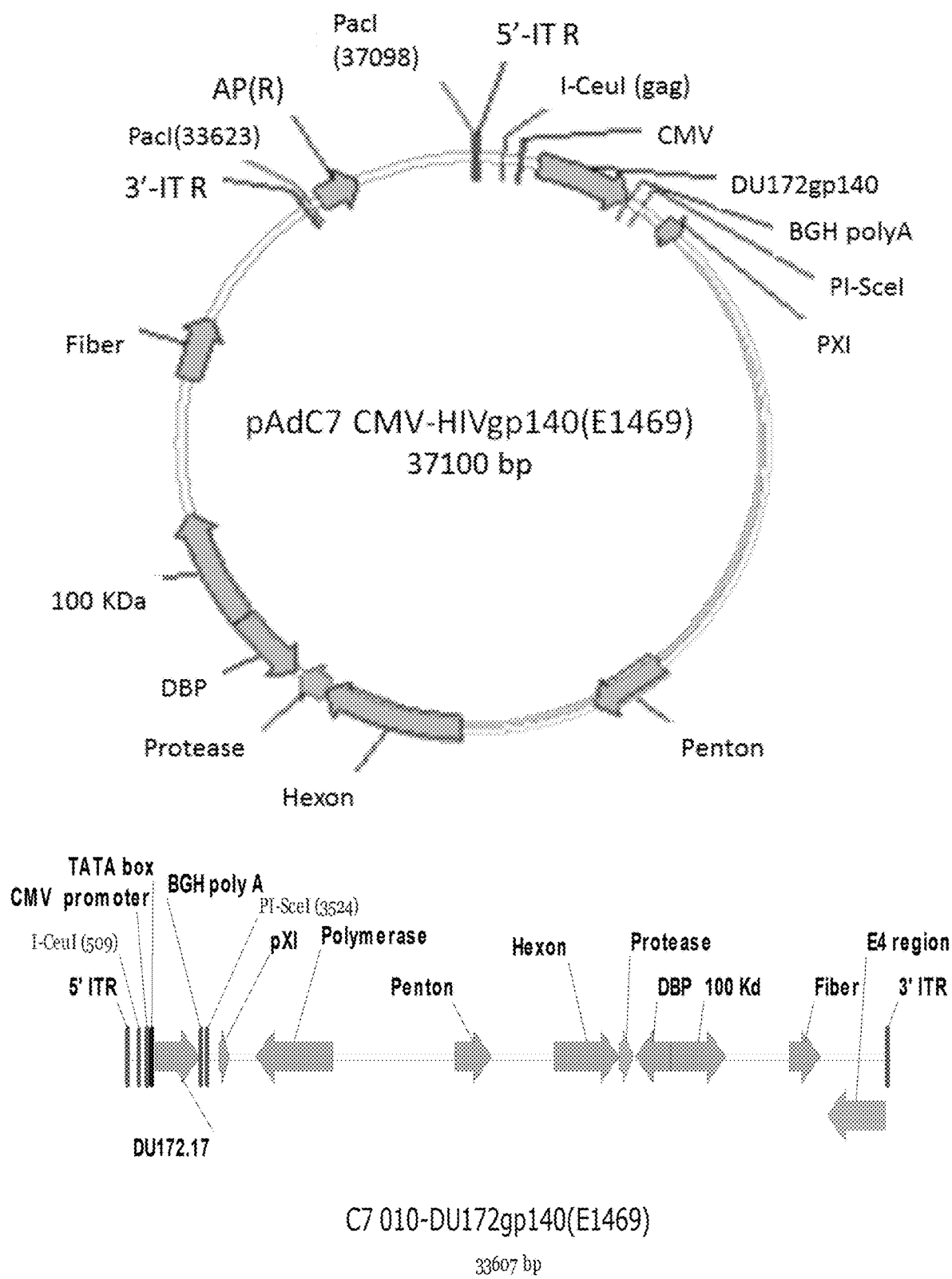
Figure 19C:
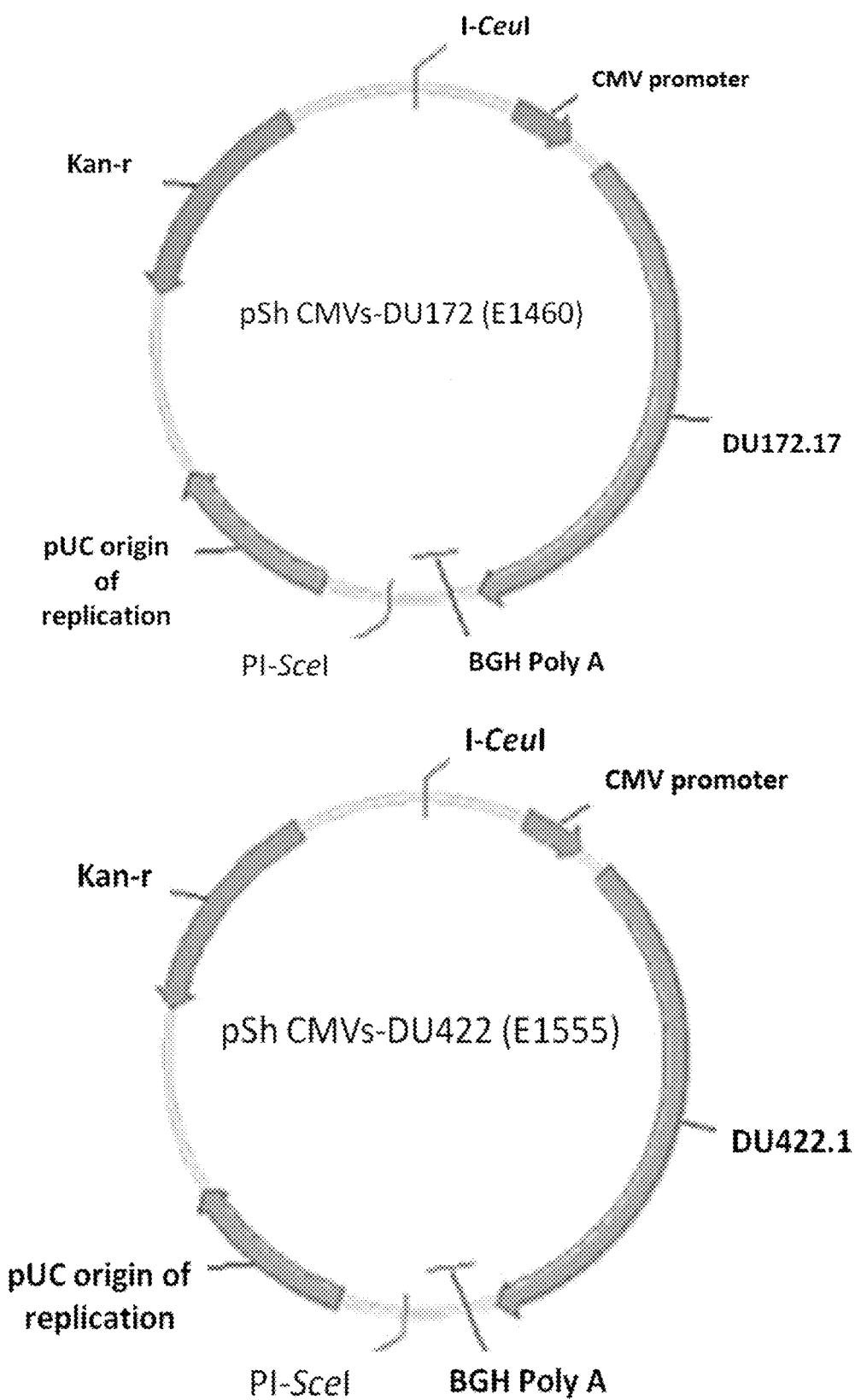
Figure 28:
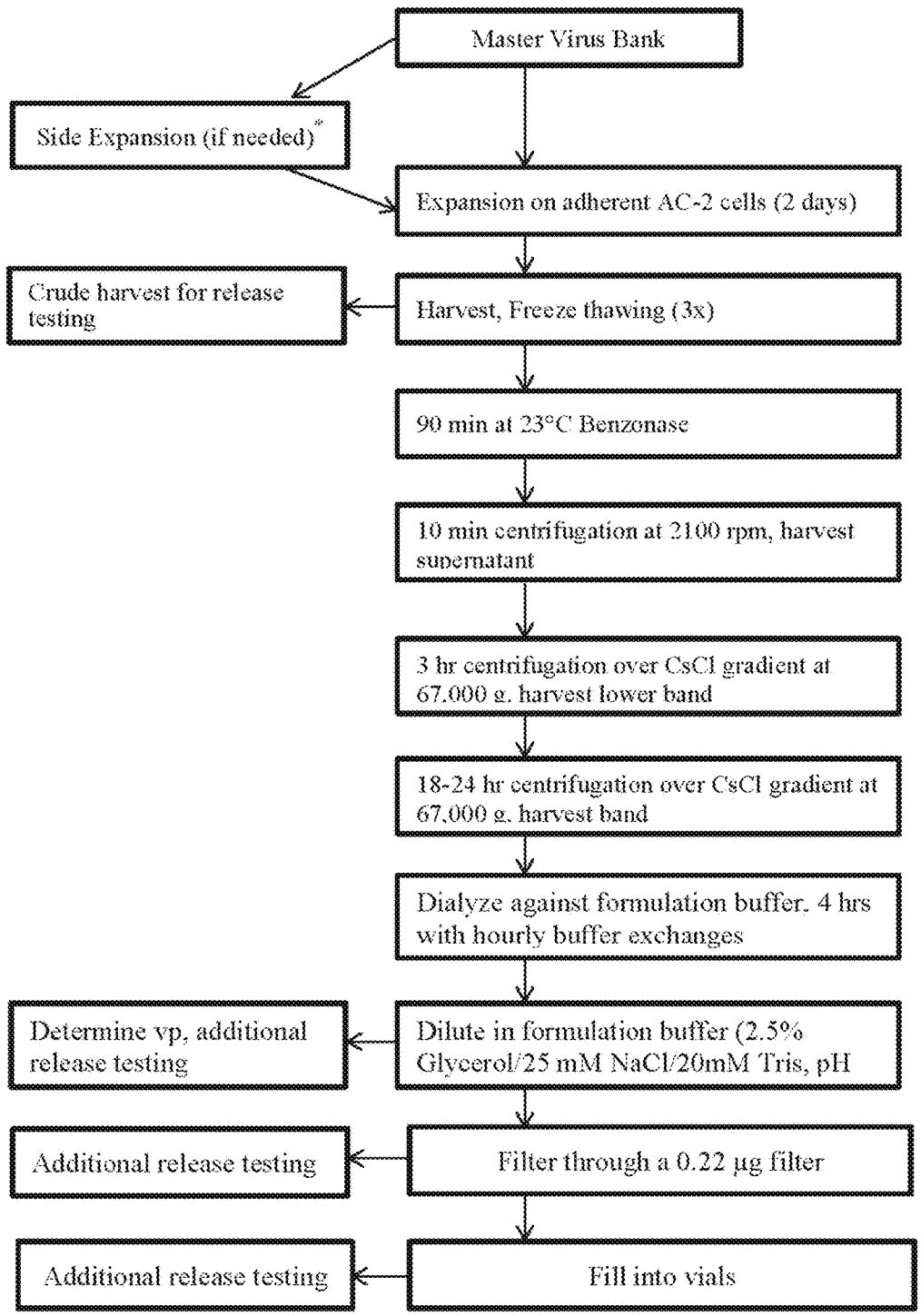
FIG. 28 is a manufacturing flow chart which depicts the production process for the AdC6 and AdC7 vaccines. Release testing of the AdC6-HIVgp140 and AdC7-HIVgp140 were finalized.

*Nucleotide numbers are based on Genbank accession numbers that are AY530877 for AdC6 (wildtype) and AY530878 for AdC7 (wildtype) type Example 8: Vaccines Design, Construction and Characterization: Recombinant AdC6 and AdC7 Vectors Maps of AdC6 and AdC7 vectors expressing Env are shown in FIGS. 19A-19B. Maps of pShuttle plasmids containing gp140 (DU172 and DU422) are shown in FIG. 19C During the manufacturing process, restriction mapping analysis or a PCR-based identification assay is be performed on Master Viral Bank and Vaccine Bulk Substance to assess the integrity of the viral genome.

The nucleotide and amino acid sequences of the AdC vectors of the present invention (AdC6 and AdC7) expressing gp140, Gag or gp160 are provided herein FIGS. 20-27 (SEQ ID NOs: 1-16).

Example 9: Manufacturing Process

Master Viral Bank (MVB)

The plasmids containing the sequence of the AdC vector with the HIV gene inserts were linearized by restriction enzyme digestion and then transfected into SAFC Pharma's AC-2 cell line that is a HEK-293 based cell line (SAFC® Pharma, MilliporeSigma-Carlsbad, Calif.). After the transfections, recombinant viral clones were selected by three rounds of plaque purification. Six to twelve clones from each transfection were produced and an aliquoted. Six clones from each transfection with the highest infectious titers were amplified and tested for production yield (in virus particle and infectious particle), immunogenicity in mice, and genetic integrity (by restriction mapping analysis). Following a selection of one final clone for each construct, each final vector clone was expanded to generate a primary seed stock that was tested (for bioburden, endotoxin, mycoplasma and infectious titer) prior to use in subsequent processes. The primary viral seed stocks were characterized for production parameters (multiplicity of infection and time to harvest) for use in later development and production activities.

The primary viral seed stocks were used to manufacture Master Viral Banks (MVBs) with AC-2 Working Cell Bank under cGMP conditions (SAFC® Pharma). AC-2 cells were grown in adherent form in conditioned medium supplied with fetal bovine serum (purchased from Cell Genesys Inc. for AdC-HIVgp140 vectors) prior to adaptation to suspension in serum-free medium. The MVBs were produced in suspension (without fetal bovine serum) in five liter WAVE™ scale. Cells were harvested, lysed by freeze thawing, and then clarified by low speed centrifugation followed by filtration. The cleared supernatants from cell lysates were filled into approximately two hundred cryovials for each MVB.

Tests performed on each MVB samples and release specifications are listed in Table 2. In some embodiments, the clinical vaccine products release and stability specification of vp to IU ratio to be used is 600:1.

TABLE 2

Release Tests and Specifications for AdC Recombinant vector MVBs

| Test | Method | Release Specification | AdC6-gp140 | AdC7-gp140 |
|---|---|---|---|---|
| Sterility | Immersion (Direct inoculation) (USP/21 CFR 610.12) | No bacteria or fungus found | Pass | Pass |

TABLE 2-continued

Release Tests and Specifications for AdC Recombinant vector MVBs

| Test | Method | Release Specification | AdC6-gp140 | AdC7-gp140 |
|---|---|---|---|---|
| Sterility Method Suitability | Immersion (Direct inoculation) (EP/USP) | No interference | Pass | Pass |
| Mycoplasma | Indirect method and direct cultivation (Points To Consider) | Negative | Pass | Pass |
| Endotoxin | Kinetic chromogenic Limulus Amebocyte Lysate assay | <10 EU/mL | Pass | Pass |
| In Vitro assay for adventitious viral contaminants | Inoculation of 3 cell lines with hemadsorption and hemagglutination endpoints | Negative | | Pass |
| In Vivo assay for adventitious viral contaminants | Inoculation of embryonated hen eggs, adult and newborn mice | Negative | | Pass |
| Detection of Porcine Circovirus DNA | Polymerase chain reaction (PCR) | Negative | | Pass |
| Detection of Adventitious bovine viruses | Cultivation on detector cell lines and fluorescent antibody staining (9 CFR) | Negative | | Pass |
| Detection of Adventitious porcine viruses | Cultivation on detector cell lines and fluorescent antibody staining (9 CFR) | Negative | | Pass |
| Quantitative PCR (qPCR) assay for potency determination | qPCR assay of hexon from cells infected with serial dilutions of AdC vector | Vp to IU ratio = 600:1 | | |
| Detection of 14 viruses (SV-40, HIV-1, HIV-2, HTLV-I, HTLV-II, hepatitis A virus, CMV, EBV, parvovirus B-19, human herpes viruses-6, -7, -8) | Real Time PCR (Human Panel I) | Negative | | Pass |
| Quantification of Reverse Transcriptase Activity | QFPERT | Negative | | Pass |
| Detection of adeno-associated virus | Real-time PcR | Negative | | Pass |

MVBs for both recombinant vectors have been completed and are stored at ≤−65° C. at SAFC Pharma under cGMP conditions.

Vaccine Drug Substance

Production of the Current Good Manufacturing Practice (cGMP) drug substance AdC vector lots are in process, thus far the bulk lot for AdC7-HIV-gp140 has been produced and conditions for AdC6-HIVgp140 production have been established. Several process development (PD) runs were performed for the two gp140-expressing vector constructs utilizing the vector MVBs and AC-2 Working Cell Bank. The PD runs showed that viral yields were higher when virus was grown on adherent rather than suspension cells. For this reasons AC-2 cells were grown in adherent form in medium supplied with 10% fetal bovine serum, gamma-irradiated and grown in CellSTACK® Cell Culture Chambers (8 for AdC7 and 40 for AdC6). Cells were plated for 3 days and then infected with 0.08 moi of virus per 90% of the cell monolayer shows cytopathic effects (CPEs). Cells were lysed by 3 rounds of freeze thawing. The lysate were treated for 90 min at 23° C. with Benzonase to remove cellular DNA. Debris were then removed by a 10 min low speed (2100 rpm) centrifugation at room temperature. Supernatant is centrifuged at 67,000 g for 3 hrs at 4° C. over a $CsCl_2$ gradient. The viral band were harvested and centrifuged over a $CsCl_2$ gradient at 67,000 g at 4° C. for 18-24 hrs. The band is harvested and dialyzed against formulation buffer for a total of 4 hours with hourly buffer exchanges. An aliquot of the dialyzed material is used to determine (vp) content. The material is diluted to $10^{12}$vp per ml in formulation buffer (2.5% Glycerol/25 mM NaCl/20 mM TRIS, pH 8.0) and then filtered through a 0.22 μm filter. The vaccine bulk filled lot were stored at ≤−65° C. under cGMP conditions. Samples from each bulk lot is tested for release and the release specifications and results are listed below in Tables 3 and 4.

TABLE 3

Release Tests and Specifications for Bulk Harvest Lots

| Test | Method | Release Specification | AdC6-gp140 | AdC7-gp140 |
|---|---|---|---|---|
| Mycoplasma | Direct cultivation by PTC/EP/USP | Negative | | Pass |
| Mycoplasmastasis | Indirect method by PTC/EP/USP (Points To Consider) | Negative | | Pass |
| In Vitro assay for adventitious viral contaminants | Inoculation of 3 cell lines with hemadsorption and hemagglutination endpoints | Negative | | Pass |
| In Vivo assay for adventitious viral contaminants | Inoculation of embryonated hen eggs, adult and newborn mice | Negative | | Pass |
| Detection of Porcine Circovirus DNA | Polymerase chain reaction | Negative | | Pass |

TABLE 3-continued

Release Tests and Specifications for Bulk Harvest Lots

| Test | Method | Release Specification | AdC6-gp140 | AdC7-gp140 |
|---|---|---|---|---|
| Detection of Adventitious bovine viruses | Cultivation on detector cell lines and fluorescent antibody staining (9 CFR) | Negative | | Pass |
| Detection of Adventitious porcine viruses | Cultivation on detector cell lines and fluorescent antibody staining (9 CFR) | Negative | | Pass |
| Detection of 15 human viruses (SV-40, HIV-1, HIV-2, HTLV I, HTLV II, HAV, HBV, HCV, CMV, EBV, Parvovirus B-19, HHV-6, HHV-7, HHV-8) | Real-time polymerase chain reaction | Negative | | |
| Quantification of reverse transcriptase activity | Ultracentrifugation and quantitative fluorescent product enhanced reverse transcriptase assay (QFPERT) | Negative | | Pass |
| Quantitative PCR (qPCR) assay for potency determination | qPCR assay of hexon from cells infected with serial dilutions of AdC vector | Vp to IU ratio = 600:1 | | |
| Detection of residual host cell DNA | Polymerase chain reaction assay | ≤10 ng/dose | | |
| Detection of AAV | qPCR | <0.2 ng/mL | | Pass |

TABLE 4

Release Tests and Specifications for Drug Substance Bulk Lots

| Test | Method | Release Specification | AdC6-gp140 | AdC7-gp140 |
|---|---|---|---|---|
| Bioburden | Microbial enumeration test (USP/61) | Negative | | Pass |
| Determination of virus concentration | UV spectrophotometry UV/OD | Report results | | Pass |
| Endotoxin | Kinetic chromogenic Limulus Amebocyte Lysate assay | <10 EU/mL | | Pass |
| Detection of residual benzonase | Enzyme immunoassay | <0.2 ng/mL | | Pass |
| Detection of Human DNA | qPCR | Negative | | Pass |
| Detection of replication competent adenovirus (RCA) | Using A549 detector cells | <1 RCA/ $3 \times 10^{10}$ vp | | |
| Quantitative PCR (qPCR) assay for potency determination | qPCR assay of hexon from cells infected with serial dilutions of AdC vector | Vp to IU ratio = 600:1 | | |
| Viral safety assay | In vivo toxicity in mice and rabbits | Report results | | |

Vaccine Fill and Finish

Bulk vaccine is diluted in 2.5% Glycerol, 25 mM Sodium chloride, 20 mM Tris pH 8.0 formulation buffer for filling. To fill and finish the final clinical recombinant AdC vector vaccines one product fill per vector are performed under cGMP conditions. Following the completion of the product fill at ~1 ml for a dose of $5 \times 10^{10}$ vp per ml, a review of the lot file and receipt of satisfactory test results for sterility, endotoxin and *mycoplasma*, a Certificate of Compliance is issued. Moreover, a Certificate of Analysis is issued by the Quality Assurance (SRI International, Menlo Park, Calif.) after obtaining all satisfactory release testing results and reviewing the related production batch records. The final release testing for the recombinant AdC vector vaccines filled product is presented in Table 5. The product is stored frozen at, ≤−65° C.

TABLE 5

Final Release Tests and Specifications for Recombinant AdC Vector Vaccines

| Test | Method | Release Specification |
|---|---|---|
| Appearance | Visual | Clear to slightly cloudy |
| Sterility | Immersion (Direct inoculation) (USP/21 CFR 610.12) | No bacteria or fungus found. |
| Endotoxin | Kinetic chromogenic Limulus Amebocyte Lysate assay | <10 EU/mL |
| Determination of virus concentration | UV spectrophotometry | Report results |
| Quantitative PCR (qPCR) assay for potency determination | qPCR assay of hexon from cells infected with serial dilutions of AdC vector | Vp to IU ratio = 600:1 |
| Sequencing of viral DNA | Massively Parallel Sequencing | Report results |
| General safety | 21 CFR 610.11 | No sign of toxicity |

Stability

Stability of filled drug product is tested over time. Vialed vector vaccine (stored at <−65° C.) and is tested the first year in 3 monthly intervals for potency and appearance. The second year the vialed vaccine is tested every 6 months and thereafter annually.

Example 10: Preclinical Studies

Immunogenicity

During selection of the two adenovirus vectors, AdC6 and AdC7, immunogenicity evaluations were conducted in mice and nonhuman primates as described in the Example 8 above.

Non-Clinical Safety and Biodistribution Studies

Preclinical safety and biodistribution studies are conducted in accordance with the U.S. FDA "Good Laboratory Practice for Nonclinical Laboratory Studies," as described in 21 CFR Part 58.

1. GLP single dose safety toxicology studies that include Day 4 and Day 29 biodistribution analysis in rabbits with AdC6-HIVgp140 and AdC7-HIVgp140
2. GLP single dose 12 week biodistribution study in rabbits for AdC6-HIVgp140 and AdC7-HIVgp140
3. Prime-boost study in rabbits consisting of AdC7-HIVgp140 prime followed by a AdC6-HIVgp140 boost 29 days later.

Information from these studies is used to define a no-observed-adverse-effect-level (NOAEL) and to identify potential target organs of toxicity. In each of these preclinical studies, New Zealand white rabbits receive a single dose of vector that is higher than the highest dose planned for use in humans.

Single Vector Dose Ranging Safety Studies with Early Time Point Biodistribution Analysis The study design for the single-dose definitive safety studies is presented in Table 6. In these studies, New Zealand white rabbits is administered vaccine or control article via intramuscular (i.m.) immunization on Day 1. The study design includes a vehicle control (Group 1) and two vaccine-treatment groups ($1\times10^{10}$ vp Group 2 and $1\times10^{11}$ vp Group 3) with 10 male and 10 female rabbits per dose group. Half of the rabbits per group (n=5/sex) are sacrificed on Day 4 which is 4 days after immunization. The other 5 rabbits per sex per group are sacrificed on Day 29 which is 4 weeks after immunization in order to study the reversibility of toxicity or delayed toxicity of the single immunization.

TABLE 6

Design of Safety Study for AdC6-HIVgp140 or AdC7-HIVgp140

| Group[A] | Dose Route | Vaccine Dose Level (vp) | Number of Animals Main Group[B] | Recovery Group[C] |
|---|---|---|---|---|
| 1 | i.m. | Vehicle control | 5M + 5F | 5M + 5F |
| 2 | i.m. | $1 \times 10^{10}$ | 5M + 5F | 5M + 5F |
| 3 | i.m. | $1 \times 10^{11}$ | 5M + 5F | 5M + 5F |

[A]Ten per sex per group are immunized once with the vaccine or vehicle.
[B]Main Group, five animals/sex/group are sacrificed 4 days after immunization
[C]Recovery Group, five animals/sex/group are sacrificed 4 weeks after immunization The Vaccine Safety Studies include the parameters listed below herein:
  Mortality: at least once daily.
  Clinical Observation: pre dose, 2-4 hr post-dose, once daily for 5 days post-dose, otherwise once weekly, and at necropsy:
  Body Weight: Pre-study, weekly thereafter, and at sacrifice.
  Body Temperature: pre-dose, 3, 24, and 48 hr post-dose or until the rabbit's temperature returns to normal.
  Food Consumption: daily for the 3 days post-dose and otherwise once weekly (quantitatively measured over a 24 hr period).
  Local Reactogenicity: Local irritation at the injection sites is evaluated by a modified Draize scoring method at pre-dose, 2-4, 24, 48, and 72 hr after each injection. Any animals with irritation at the last time point, are evaluated once daily until irritation resolves.
  Ophthalmology: Pre-Study and post-dose within 1 week prior to scheduled sacrifice.
  Clinical Pathology: hematology, serum chemistry, and coagulation are pretested, 1 day after immunization (5/sex/group), and at the recovery necropsy.
  Urinalysis: at necropsy
  Antibody Response: Serum samples are collected pretest and at sacrifice and archived for possible antibody analysis (e.g. anti-HIV antibodies, neutralizing antibodies).
  Necropsy and Organ Weight: All animals at main and recovery sacrifice.
  Histopathology: All tissues in the control and high dose groups at the main study sacrifice. Any target organs is examined in the other dose groups and from the recovery group animals. All gross lesions are examined.
  Biodistribution: All high dose Group 3 rabbits (5/sex/time point) and 3 rabbits/sex/time point from vehicle control Group 1 are analyzed for biodistribution of the vector at sacrifice (Days 4 and 29).

The final report includes a discussion correlating clinical signs, body weight changes, clinical pathology, hematopoietic and immune function changes, histopathology, and when applicable, biodistribution. Statistical evaluation of body weight, food consumption, body temperature, clinical pathology parameters, and organ weights are conducted. The no observed adverse effect level (NOAEL) and maximum tolerated dose (MTD), is also determined.

Clinical Pathology

Clinical pathology determinations (hematology and clinical chemistry panel) is conducted on blood samples collected at selected time-points from the ear vein without anesthesia. Hematology samples are collected using EDTA as the anticoagulant. Smears for reticulocytes and differentials are prepared within one hour of sample collection (including MeOH fixation but excluding staining and reading). Blood for coagulation tests is collected using sodium citrate as the anticoagulant and the plasma frozen until analyzed. Clinical chemistry and antibody response samples are collected without the use of an anticoagulant, centrifuged, and the serum stored frozen until analysis.

Hematology evaluations include standard erythrocyte and leukocyte parameters: red and white blood cell (RBC and WBC) counts, hemoglobin, hematocrit, mean corpuscular volume, mean corpuscular hemoglobin and hemoglobin concentration, platelet count, mean platelet volume, reticulocyte count, and differential leukocyte count.

Clinical chemistry evaluations include a standard panel: alanine aminotransferase, aspartate aminotransferase, alkaline phosphatase, albumin, albumin/globulin ratio, blood urea nitrogen, bilirubin, calcium, chloride, cholesterol, creatinine, creatine kinase, globulin, glucose, phosphorus, potassium, total protein, sodium, and triglycerides. Coagulation parameters include prothrombin time, activated partial thromboplastin time, and fibrinogen.

Necropsy/Histopathology

At sacrifice, terminal body weights and ante mortem observations are recorded for each animal and commented on at necropsy. All protocol-specified tissues and the identification mark from each animal are saved in cold, buffered neutral 10% formalin at necropsy. Any gross findings noted at the time of necropsy is recorded and then confirmed in the subsequent microscopic evaluation. Animals in moribund condition are euthanized and receive a full necropsy as for scheduled necropsies. The recommended list of tissues to be retained for conduct of a general and comprehensive evaluation of potential target organs has been standardized. The list of tissues routinely evaluated microscopically is: Adrenal glands (pair), Aorta, Bone marrow (histology, sternum), Bone marrow (cytology, sternum), Bone (femur with joint surface), Brain (fore-, mid-, and hindbrain), Cecum, Cervix, Colon, Duodenum, Epididymes, Esophagus, Eyes (with optic nerve), Gall bladder, Gross lesions (including tissue masses and abnormal regional lymph nodes), Heart, Identification (tattoo, collected not analyzed), Injection site(s), Ileum, Jejunum, Kidneys, Liver, Lungs with bronchi, Lymph nodes (mandibular, and mesenteric and inguinal or iliac depending on dose site), Mammary gland (from both sexes; to include nipple and surrounding tissue), Ovaries, Pancreas, Pituitary gland, Prostate, Rectum, Salivary gland, Seminal vesicle, Sciatic nerve, Skeletal muscle, Skin (included with mammary gland), Spinal cord (thoracic only), Spleen, Stomach, Testes, Thymus, Thyroid and parathyroid, Trachea, Uterus, Urinary bladder, and Vagina.

Toxicologic Evaluations

Effects on the parameters evaluated in each study, e.g., microscopic lesions, are categorized as vaccine-related or non-vaccine-related, with further clarification, when possible, on whether a vaccine-related lesion is primary or secondary. The evaluation of anatomic pathology results consider and, where possible, integrate related clinical and clinical pathology data.

Biodistribution

Biodistribution analysis is conducted on DNA extracted from the tissues by a quantitative PCR (Q-PCR) assay (with sensitivity of at least 50 copies/μg of genomic DNA) using primers corresponding to the vector insert. Because each of the vaccines is manufactured from different adenovirus serotypes, the biodistribution of each vaccine is be assessed. Replicate wells spiked with plasmid encoding the insert are used to monitor PCR inhibition.

The following tissues are collected from each animal at necropsy and analyzed from each of the animals sacrificed 4 days post-dose: blood, bone marrow, brain, heart, lungs, liver, injection site muscle, kidneys, testes/ovaries, draining lymph nodes, and spleens. If vector sequence is detected 4 days post-dose, that tissue is analyzed from later time points. Expression of the transgene is also be tested using quantitative Reverse Transcription (RT)-PCR on RNA isolated from positive tissues. The results of these studies show the distribution of the vector in different tissues as a function of time post-injection.

12 Week Biodistribution Study

The study design for the 12 week biodistribution study of both vaccines tested singly is presented in Table 7. In this study, animals receive a single dose of vehicle or vaccine at $1 \times 10^{11}$ vp on Day 1 by i.m. injection and are sacrificed 12 weeks later. The tissue list for the 12 week study depends on the results of the prior studies; tissues with detectable vector at 4 weeks post-dose are analyzed for the presence of vector at 12 weeks post-dose. The biodistribution parameters (e.g., methods and endpoints) discussed above is be applied herein. This study includes weekly body weights and clinical observations to monitor the general health of the animals.

TABLE 7

Design of 12 Week Biodistribution Study for AdC6-HIVgp140 and AdC7-HIVgp140

| Group | Dose Route | Vaccine | Dose Level (vp) | Number of Animals Sacrificed at 12 wk |
|---|---|---|---|---|
| 1 | i.m. | Vehicle control | 0 | 3M + 3F |
| 2 | i.m. | AdC6-HIVgp140 | $1 \times 10^{11}$ vp | 5M + 5F |
| 3 | i.m. | AdC7-HIVgp140 | $1 \times 10^{11}$ vp | 5M + 5F |

Prime-Boost Safety Study

The study design for the prime-boost safety study is presented in Table 8. New Zealand white rabbits (5 animals/sex/group) are administered by i.m. injection vehicle control or the highest vaccine dose determined to have an acceptable safety profile in the previous single vector safety studies. A single administration of AdC7-1-11Vgp140 is used as the prime injection on Day 1. A single administration of AdC6-HIVgp140 is used as the boost and occur 4 weeks after the prime. The study is divided into a main and recovery study phase. Animals in the main group are sacrificed on Day 33 which is 4 days after the boost immunization. The recovery group animals are sacrificed on Day 57 which is 4 weeks after the boost immunization. All of the safety study parameters described for the single dose study (as listed above herein) are included in this study with the exception of the biodistribution analysis.

TABLE 8

Design of Safety Study for Prime-Boost Regimen

| Group[A] | Dose Route | Vaccine Dose (Prime-Boost) | Prime (Day 1) | Boost (Day 29) | Number of Animals Main Group[B] | Recovery Group[C] |
|---|---|---|---|---|---|---|
| 1 | i.m. | 0 | Vehicle Control | Vehicle Control | 5M + 5F | 5M + 5F |
| 2 | i.m. | $1 \times 10^{11}$ vp | AdC7-HIVgp140 | AdC6-HIVgp140 | 5M + 5F | 5M + 5F |

[A]Ten rabbits per sex per group are immunized once with the vaccine prime or vehicle on Day 1 and once with the vaccine boost or vehicle on Day 29.
[B]Main Group, five animals/sex/group are sacrificed on Day 33, 4 days after the boost immunization.
[C]Recovery Group, five animals/sex/group are sacrificed on Day 57, 4 weeks after the boost immunization.

Example 11: Objectives and Endpoints

Primary Objective

To evaluate the safety and tolerability of AdC6HIVgp140 and AdC7HIVgp140 at doses from $1 \times 10^9$ vp to $5 \times 10^{10}$ vp in HIV-1 uninfected adults Primary Endpoints Frequency and severity of local reactogenicity signs and symptoms Frequency and severity of systemic reactogenicity signs and symptoms Frequency of AEs categorized by MedDRA body system, MedDRA preferred term, severity and assessed relationship to study products. Detailed description of all AEs meeting DAIDS criteria for expedited reporting.

Secondary Objective

To gain preliminary data on the immunogenicity of AdC6HIVgp140 and AdC7HIVgp140 in HIV-1 uninfected adults Secondary Endpoints HIV-specific $CD4^+$ and $CD8^+$ T-cell response rates Magnitude of HIV-specific $CD4^+$ and $CD8^+$ T-cell responses Frequency, magnitude and breadth of HIV-specific binding antibody responses as assessed by multiplex assay Neutralizing antibody frequency, magnitude and breadth against tier 1 and, if applicable, tier 2 HIV-1 isolates as assessed by area under the magnitude-breadth curves The disclosures of each and every patent, patent application, and publication cited herein are hereby incorporated herein by reference in their entirety.

While this invention has been disclosed with reference to specific embodiments, it is apparent that other embodiments and variations of this invention may be devised by others skilled in the art without departing from the true spirit and scope of the invention. The appended claims are intended to be construed to include all such embodiments and equivalent variations.

SEQUENCE LISTING (25 sequences)

SEQ ID NO: 1 - DNA, 32767 bp, Artificial Sequence
  Artificially Synthesized
catcatcaataatatacctcaaacttttggtgcgcgttaatatgcaaatgagctgtttgaatttggggagggaggaaggtgattggctgcgggagcggcgaccgttaggggcggggcgggtgacgttttgatgacgtggctatgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagtatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaaggctagagttcgacgccaccatgcgcgtgcgcggcatcccccgcaactggccccagtggtggatctggggcatcctgggcttctggatgatcatcatctgccgcgtggtgggcaacctggacctgtgggtgaccgtgtactacggcgtgcccgtgtggaaggaggccaagaccaccctgttctgcgcctccgacgccaaggcctacgacaaggaggtgcacaacgtgtgggccacccacgcctgcgtgcccaccgaccccaacccccaggagatcgtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgcaagaacgtgaacatctccgccaacgccaacgccaccgccaccctgaactcctccatgaacggcgagatcaagaactgctccttcaacaccaccaccgagctgcgcgacaagaagcagaaggtgtacgccctgttctacaagcccgacgtggtgcccctgaacggcggcgagcacaacgagaccggcgagtacatcctgatcaactgcaactcctccaccatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggagatcatcgtgcgctccgagaacctgaccaacaacatcaagaccatcatcgtgcacctgaacaagtccgtggagatcaagtgcacccgccccaacaacaacacccgcaagtccgtgcgcatcggccccggccagaccttctacgccaccggcgagatcatcggcgacatccgcgaggcccactgcaacatctcccgcgagacctggaactccaccctgatccaggtgaaggagaagctgcgcgagcactacaacaagaccatcaagttcgagccctcctccggcggcgacctggaggtgaccacccactccttcaactgccgcggcgagttcttctactgcgacaccaccaagctgttcaacgagaccaagctgttcaacgagtccgagtacgtggacaacaagaccatcatcctgccctgccgcatcaagcagatcatcaacatgtggcaggaggtgggccgcgccatgtacgccccccccatcgagggcaacatcacctgcaagtccaacatcaccggcctgctgctgacctgggacggcggcgagaactccaccgagggcgtgttccgccccggcggcggcaacatgaaggacaactggcgctccgagctgtacaagtacaaggtggtggagatcaagcccctgggcgtggcccccaccaagtccaagctgaccgtgcaggcccgccagctgctgtccggcatcgtgcagcagcagtccaacctgctgcgcgccatcgaggcccagcagcacctgctgcagctgaccgtgtggggcatcaagcagctgcagacccgcgtgctggccatcgagcgctacctgaaggaccagcagctgctgggcctgtggggctgctccggcaagctgatctgcgccaccgccgtgccctggaactcctcctggtccaacaagtccctgggcgacatctgggacaacatgacctggatgcagtgggaccgcgagatctccaactacaccaacaccatcttccgcctgctggaggactcccagaaccagcaggagaagaacgagaaggacctgctggccctggactcctggaagaacctgtggaactggttcgacatcaccaactggctgtggtaaggtacctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggtcagatatcgacatatgctggccaccgtgcatgtggcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttggggctgggtgtgagcctgcatgaggggcagaatgactaaaatctgtggttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcggggatggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcaaccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatttggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagattgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctttggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttaggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgttggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttggcgaggaatttcagtgggcagtggagcgctggcggctgcatctcgtgctgtactacgtcttggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggctacgtccacggcttgcagggtgccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgttccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcttccatctcctcctcttcctcctccactaacatctcttctacttcctcctcaggaggcggtggcgggggaggggccctgcgtcgccggcggcgcacgggcagacggtcgatgaagcgctcgatggtctccccgcgccggcgacgcatggtctcggtgacggcgcgcccgtcctcgcggggccgcagcatgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggtgaggatggcctgctggatctgggtgagggtggtctggaagtcgtcgaagtcgacgaagcggtggtaggctccggtgttgatggtgtaggagcagttggccatgacggaccagttgacggtctggtggccgggtcgcacgagctcgtggtacttgaggcgcgagtaggcgcgcgtgtcgaagatgtagtcgttgcaggcgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcggccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttttttcttgtgtttttgccagatgcatcccgtactgcggcagatgcgcccccaccctccaccacaaccgcccctaccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattttgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggtgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcggacaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgcggcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgtccaggaaccaatgccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcgaccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcgcaggcacccgtagacgccagcggcacgacaggcagcggggactggtgtgggacgatgaggattccgccgacgacagcagcgtgttggacttgggtgggagtggtggtaacccgttcgctcacctgcgcccccgtatcgggcgcctgatgtaagaatctgaaaaaataaaagacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcagacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtggatgatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcaccgccgcggcgaccgcagccgtggccaccgcctctaccgaggtgcggggcgataattttgctagcgctgcggcagcggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcaccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcgtacggcaagcgcagccgccccgcgcccttgaaagaggaggcggtgtccatcccgctggaccacggcaaccccacgccgagcctgaagccggtgaccctgcagcaggtgctaccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccagcaccagcttccaccagcactcgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgtcgtcgcagccgccgcagcagcaccgcgacttccgccttggtgcggagagtgtatcgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacaaaaaagcatggatttgtaataaaaaaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagaacagaacttccagcagaaggtggttgatggcctggcctcaggcatcaacggggtggttgacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggcctgcccaccacgcggcccgtggcgcctctggccaccggagtgctgaaacccagcagcagccagcccgcgaccctggacttgcctccgcctcgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggagtgtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactctggcaccgcctacaacagcctagctcccaagggagctcccaattccagccagtgggagcaagcaaaaacaggcaatgggggaactatggaaacacacacatatggtgtggccccaatgggcggagagaatattacaaaagatggtcttcaaattggaactgacgttacagcgaatcagaataaaccaatttatgccgacaaaacatttcaaccagaaccgcaagtaggagaagaaaattggcaagaaactgaaaacttttatggcggtagagctcttaaaaaagacacaaacatgaaaccttgctatggctcctatgctagacccaccaatgaaaaaggaggtcaagctaaacttaaagttggagatgatggagttccaaccaaagaattcgacatagacctggctttctttgatactcccggtggcaccgtgaacggtcaagacgagtataaagcagacattgtcatgtataccgaaaacacgtatttggaaactccagacacgcatgtggtatacaaaccaggcaaggatgatgcaagttctgaaattaacctggttcagcagtctatgcccaacagacccaactacattgggttcagggacaactttatcggtcttatgtactacaacagcactggcaatatgggtgtgcttgctggtcaggcctcccagctgaatgctgtggttgatttgcaagacagaaacaccgagctgtcctaccagctcttgcttgactctttgggtgacagaacccggtatttcagtatgtggaaccaggcggtggacagttatgaccccgatgtgcgcatcatcgaaaaccatggtgtggaggatgaattgccaaactattgcttccccttggacggctctggcactaacgccgcataccaaggtgtgaaagtaaaagatggtcaagatggtgatgttgagagtgaatgggaaaatgacgatactgttgcagctcgaaatcaattatgtaaaggtaacattttcgccatggagattaatctccaggctaacctgtggagaagtttcctctactcgaacgtggccctgtacctgcccgactcctacaagtacacgccgaccaacgtcacgctgccgaccaacaccaacacctacgattacatgaatggcagagtgacacctccctcgctggtagacgcctacctcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctaggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctgaagacccgcgagacgccctcgctcggctccgggttcgacccctacttcgtctactcgggctccatcccctacctagacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaagccgtctacctgcgcacgcccttctcggccggcaacgccaccacctaagccgctcttgcttcttgcaagatgacggcgggctccggcgagcaggagctcagggccatcctccgcgacctgggctgcgggccctgcttcctgggcaccttcgacaagcgcttccctggattcatggccccgcacaagctggcctgcgccatcgtgaacacggccggccgcgagaccgggggcgagcactggctggccttcgcctggaacccgcgctcccacacatgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaagcgctctaccgcttcctcaatgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccggcgtcgtgcacgcagcagcgcgcgtcgttgttggccagctgcaccacgctgcgcccccagcggttctgggtgatcttggcccggttggggttctccttcagcgcgcgctgcccgttctcgctcgccacatccatctcgatagtgtgctccttctggatcatcacggtcccgtgcaggcaccgcagcttgccctcggcttcggtgcagccgtgcagccacagcgcgcagccggtgcactcccagttcttgtgggcgatctgggagtgcgagtgcacgaagccctgcaggaagcggcccatcatcgcggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcgatgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggagagcgcgagttctcgttcaccacgactatttcttcttcttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaacaacaagcatggagactcagccatcgtcgccaacatcgccatctgcccccgccgccaccgccgacgagaaccagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagaacgagcagaaccaggctgggcacgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgtgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagttcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctggagtgccactgccgctgcaacctctgcacgccgcaccgctccctggcctgcaacccccagctgctgagcgagacccagatcatcggcaccttcgagttgcaaggccccggcgacggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagaaaaccagcggcagcagcagctagaaaatccacagcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccagcccacggagtgcggatcatcgtcgaagggggcctcgactcccacctgcttcggatcttcagccagcgaccgatcctggtcgagcgcgaacaaggacagacccttcttactttgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcaggaccctgccatcacaccttccacctgatcccgaataccacagcgccgctccccgctactaacaaccaaactacccaccaacgccaccgtcgcgacctttcctctgaatctaataccactaccggaggtggcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgatttaaataaaaaaaataatcatttgatttgaaataaagatacaatcatattgatgatttgagtttaacaaaaataaagaatcacttacttgaaatctgataccaggtctctgtccatgttttctgccaacaccacctcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggctgaccccgtcaccaccaagaacggggaaatcaccctcaagctgggagagggggtggacctcgactcgtcgggaaaactcatctccaacacggccaccaaggccgccgcccctctcagtatttcaaacaacaccatttcccttaaaactgctgcccctttctacaacaacaatggaactttaagcctcaatgtctccacaccattagcagtatttcccacatttaacactttaggcataagtcttggaaacggtcttcagacttcaaataagttgttgactgtacaactaactcatcctcttacattcagctcaaatagcatcacagtaaaaacagacaaagggctatatattaactccagtggaaacagaggacttgaggctaatataagcctaaaaagaggactagtttttgacggtaatgctattgcaacatatattggaaatggcttagactatggatcttatgatagtgatggaaaaacaagacccgtaattaccaaaattggagcaggattaaattttgatgctaacaaagcaatagctgtcaaactaggcacaggtttaagttttgactccgctggtgccttgacagctggaaacaaacaggatgacaagctaacactttggactacccctgacccaagccctaattgtcaattactttcagacagagatgccaaatttactctctgtcttacaaaatgcggtagtcaaatactaggcactgtggcagtggcggctgttactgtaggatcagcactaaatccaattaatgacacagtcaaaagcgccatagttttccttagatttgattccgatggtgtactcatgtcaaactcatcaatggtaggtgattactggaactttagggagggacagaccactcaaagtgtagcctatacaaatgctgtgggattcatgccaaatataggtgcatatccaaaaacccaaagtaaaacacctaaaaatagcatagtcagtcaggtatatttaactggagaaactactatgccaatgacactaaccataactttcaatggcactgatgaaaaagacacaaccccagttagcacctactctatgacttttacatggcagtggactggagactataaggacaaaaatattacctttgctaccaactcattctctttttcctacatcgcccaggaataatcccacccagcaagccaaccccttttcccaccacctttgtctatatggaaactctgaaacagaaaaataaagttcaagtgttttattgaatcaacagttttacaggactcgagcagttatttttcctccaccctcccaggacatggaatacaccaccctctccccccgcacagccttgaacatctgaatgccattggtgatggacatgcttttggtctccacgttccacacagtttcagagcgagccagtctcggatcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggttcgggtccagggactccctcagcatgatgcccacggccctcagcatcagtcgtctggtgcggcgggcgcagcagcgcatgcgaatctcgctcaggtcactgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaagacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccggatcccggcaatgacaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttctcgaccgtgtcatgatgcagttgctttcggacattttcgtacttgctgtagcagaacctggtccgggcgctgcacaccgatcgccggcggcggtctcggcgcttggaacgctcggtgttaaagttgtaaaacagccactctctcagaccgtgcagcagatctagggcctcaggagtgatgaagatcccatcatgcctgatagctctgatcacatcgaccaccgtggaatgggccaggcccagccagatgatgcaattttgttgggtttcggtgacggcgggggagggaagaacaggaagaaccatgattaacttttaatccaaacggtctcggagcacttcaaaatgaaggtcacggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaaccatcatgttacactcctgcaccatccccagataattttcatttttccagccttgaatgattcgaactagttcctgaggtaaatccaagccagccatgataaaaagctcgcgcagagcaccctccaccggcattcttaagcacaccctcataattccaagatattctgctcctggttcacctgcagcagattgacaagcggaatatcaaaatctctgccgcgatccctgagc

SEQ ID NO: 2 - DNA, 32767 bp, Artificial Sequence
  Artificially Synthesized
catcatcaataatatacctcaaacttttggtgcgcgttaatatgcaaatgagctgtttgaatttggggagggaggaaggtgattggctgcgggagcggcgaccgttaggggcggggcgggtgacgttttgatgacgtggctatgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcgccaccatgggcgccagagccagcgtgctgagcgggggagagctggatcgctgggaaaagattagactgaggcccggagggaagaaaaagtacaagctgaaacacatcgtgtgggccagcagggagctggagcgcttcgccgtgaaccccggactgctggagacctccgaaggctgtcggcagatcctggggcagctgcagccttccctgcagacaggctccgaggagctgcggtctctgtataatacagtggccacactgtactgtgtgcaccagcggattgaggtgaaggatacaaaagaggccctggagaagattgaggaggagcagaacaagagcaagaagaaagcccagcaggccgccgccgacaccggcaatagctcccaggtgagccagaactatccaattgtgcagaatctgcagggccagatggtgcaccaggccatttccccacggacactgaacgcctgggtgaaggtggtggaggagaaggccttcagccccgaagtgatccctatgttttccgccctgtccgaaggcgccacccctcaggacctgaacaccatgctgaacacagtggggggacaccaggccgccatgcagatgctgaaggaaaccatcaacgaggaggccgccgagtgggatcggctgcaccccgtgcacgccgggccaatcgcccctggccagatgagggagcccagaggctctgacatcgccggcaccacatctaccctgcaggaacagatcgggtggatgaccaataacccaccaatcccagtgggcgagatctacaagaggtggattattctgggactgaacaaaattgtgcgcatgtattcccctacatccatcctggacatcaggcagggccctaaggaacctttccgcgactacgtggatcggttctacaaaaccctgcgcgccgagcaggccagccaggaagtgaagaattggatgacagagaccctgctggtgcagaacgccaatcctgactgtaaaaccatcctgaaggccctgggccctgccgccacactggaggaaatgatgaccgcctgccagggcgtgggcggccctggccacaaagccagggtgctggccgaggccatgtctcaggtgaccaactctgccacaattatgatgcagcgggggaactttcggaaccagaggaagaccgtgaagtgcttcaactgtggcaaggagggacacatcgccaagaattgccgcgccccacggaagaaggggtgttggaaatgcgggaaggagggccaccagatgaaagactgcacagagcggcaggccaactttctgggcaagatttggcccagccacaagggccgccccggaaactttctgcagtccaggcctgagcctaccgccccccctgaggaatccttccggttcggcgaggagacaaccaccccaagccagaagcaggaacccatcgacaaagagctgtaccccctggccagcctgagatccctgttcgggaatgaccccagctctcagtgatgatctagcgtttaaacgggccctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggtattatgggtattatgggtctgcattaatgaatcggtcagatatcgacatatgctggccaccgtgcatgtggcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttggggctgggtgtgagcctgcatgaggggcagaatgactaaaatctgtggttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcggggatggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcaaccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatttggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagattgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctttggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttaggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgttggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttggcgaggaatttcagtgggcagtggagcgctggcggctgcatctcgtgctgtactacgtcttggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggctacgtccacggcttgcagggtgccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgttccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcttccatctcctcctcttcctcctccactaacatctcttctacttcctcctcaggaggcggtggcgggggaggggccctgcgtcgccggcggcgcacgggcagacggtcgatgaagcgctcgatggtctccccgcgccggcgacgcatggtctcggtgacggcgcgcccgtcctcgcggggccgcagcatgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggtgaggatggcctgctggatctgggtgagggtggtctggaagtcgtcgaagtcgacgaagcggtggtaggctccggtgttgatggtgtaggagcagttggccatgacggaccagttgacggtctggtggccgggtcgcacgagctcgtggtacttgaggcgcgagtaggcgcgcgtgtcgaagatgtagtcgttgcaggcgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcggccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttttttcttgtgtttttgccagatgcatcccgtactgcggcagatgcgcccccaccctccaccacaaccgcccctaccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcaccttgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattttgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggtgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcggacaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgcggcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgtccaggaaccaatgccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcgaccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcgcaggcacccgtagacgccagcggcacgacaggcagcggggactggtgtgggacgatgaggattccgccgacgacagcagcgtgttggacttgggtgggagtggtggtaacccgttcgctcacctgcgcccccgtatcgggcgcctgatgtaagaatctgaaaaaataaaagacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcagacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtggatgatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcaccgccgcggcgaccgcagccgtggccaccgcctctaccgaggtgcggggcgataattttgctagcgctgcggcagcggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcaccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcgtacggcaagcgcagccgccccgcgcccttgaaagaggaggcggtgtccatcccgctggaccacggcaaccccacgccgagcctgaagccggtgaccctgcagcaggtgctaccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccagcaccagcttccaccagcactcgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgtcgtcgcagccgccgcagcagcaccgcgacttccgccttggtgcggagagtgtatcgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacaaaaaagcatggatttgtaataaaaaaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagaacagaacttccagcagaaggtggttgatggcctggcctcaggcatcaacggggtggttgacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggcctgcccaccacgcggcccgtggcgcctctggccaccggagtgctgaaacccagcagcagccagcccgcgaccctggacttgcctccgcctcgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggagtgtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactctggcaccgcctacaacagcctagctcccaagggagctcccaattccagccagtgggagcaagcaaaaacaggcaatgggggaactatggaaacacacacatatggtgtggccccaatgggcggagagaatattacaaaagatggtcttcaaattggaactgacgttacagcgaatcagaataaaccaatttatgccgacaaaacatttcaaccagaaccgcaagtaggagaagaaaattggcaagaaactgaaaacttttatggcggtagagctcttaaaaaagacacaaacatgaaaccttgctatggctcctatgctagacccaccaatgaaaaaggaggtcaagctaaacttaaagttggagatgatggagttccaaccaaagaattcgacatagacctggctttctttgatactcccggtggcaccgtgaacggtcaagacgagtataaagcagacattgtcatgtataccgaaaacacgtatttggaaactccagacacgcatgtggtatacaaaccaggcaaggatgatgcaagttctgaaattaacctggttcagcagtctatgcccaacagacccaactacattgggttcagggacaactttatcggtcttatgtactacaacagcactggcaatatgggtgtgcttgctggtcaggcctcccagctgaatgctgtggttgatttgcaagacagaaacaccgagctgtcctaccagctcttgcttgactctttgggtgacagaacccggtatttcagtatgtggaaccaggcggtggacagttatgaccccgatgtgcgcatcatcgaaaaccatggtgtggaggatgaattgccaaactattgcttccccttggacggctctggcactaacgccgcataccaaggtgtgaaagtaaaagatggtcaagatggtgatgttgagagtgaatgggaaaatgacgatactgttgcagctcgaaatcaattatgtaaaggtaacattttcgccatggagattaatctccaggctaacctgtggagaagtttcctctactcgaacgtggccctgtacctgcccgactcctacaagtacacgccgaccaacgtcacgctgccgaccaacaccaacacctacgattacatgaatggcagagtgacacctccctcgctggtagacgcctacctcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctaggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctgaagacccgcgagacgccctcgctcggctccgggttcgacccctacttcgtctactcgggctccatcccctacctagacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaagccgtctacctgcgcacgcccttctcggccggcaacgccaccacctaagccgctcttgcttcttgcaagatgacggcgggctccggcgagcaggagctcagggccatcctccgcgacctgggctgcgggccctgcttcctgggcaccttcgacaagcgcttccctggattcatggccccgcacaagctggcctgcgccatcgtgaacacggccggccgcgagaccgggggcgagcactggctggccttcgcctggaacccgcgctcccacacatgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaagcgctctaccgcttcctcaatgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccggcgtcgtgcacgcagcagcgcgcgtcgttgttggccagctgcaccacgctgcgcccccagcggttctgggtgatcttggcccggttggggttctccttcagcgcgcgctgcccgttctcgctcgccacatccatctcgatagtgtgctccttctggatcatcacggtcccgtgcaggcaccgcagcttgccctcggcttcggtgcagccgtgcagccacagcgcgcagccggtgcactcccagttcttgtgggcgatctgggagtgcgagtgcacgaagccctgcaggaagcggcccatcatcgcggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcgatgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggagagcgcgagttctcgttcaccacgactatttcttcttcttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaacaacaagcatggagactcagccatcgtcgccaacatcgccatctgcccccgccgccaccgccgacgagaaccagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagaacgagcagaaccaggctgggcacgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgtgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagttcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctggagtgccactgccgctgcaacctctgcacgccgcaccgctccctggcctgcaacccccagctgctgagcgagacccagatcatcggcaccttcgagttgcaaggccccggcgacggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagaaaaccagcggcagcagcagctagaaaatccacagcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccagcccacggagtgcggatcatcgtcgaagggggcctcgactcccacctgcttcggatcttcagccagcgaccgatcctggtcgagcgcgaacaaggacagacccttcttactttgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcaggaccctgccatcacaccttccacctgatcccgaataccacagcgccgctccccgctactaacaaccaaactacccaccaacgccaccgtcgcgacctttcctctgaatctaataccactaccggaggtgagctccgaggtcgaccaacctctgggatttactacggcccctgggaggtggtggggttaatagcaaataaaaaaaataatcatttgatttgaaataaagatacaatcatattgatgatttgagtttaacaaaaataaagaatcacttacttgaaatctgataccaggtctctgtccatgttttctgccaacaccacctcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggctgaccccgtcaccaccaagaacggggaaatcaccctcaagctgggagagggggtggacctcgactcgtcgggaaaactcatctccaacacggccaccaaggccgccgcccctctcagtatttcaaacaacaccatttcccttaaaactgctgcccctttctacaacaacaatggaactttaagcctcaatgtctccacaccattagcagtatttcccacatttaacactttaggcataagtcttggaaacggtcttcagacttcaaataagttgttgactgtacaactaactcatcctcttacattcagctcaaatagcatcacagtaaaaacagacaaagggctatatattaactccagtggaaacagaggacttgaggctaatataagcctaaaaagaggactagtttttgacggtaatgctattgcaacatatattggaaatggcttagactatggatcttatgatagtgatggaaaaacaagacccgtaattaccaaaattggagcaggattaaattttgatgctaacaaagcaatagctgtcaaactaggcacaggtttaagttttgactccgctggtgccttgacagctggaaacaaacaggatgacaagctaacactttggactacccctgacccaagccctaattgtcaattactttcagacagagatgccaaatttactctctgtcttacaaaatgcggtagtcaaatactaggcactgtggcagtggcggctgttactgtaggatcagcactaaatccaattaatgacacagtcaaaagcgccatagttttccttagatttgattccgatggtgtactcatgtcaaactcatcaatggtaggtgattactggaactttagggagggacagaccactcaaagtgtagcctatacaaatgctgtgggattcatgccaaatataggtgcatatccaaaaacccaaagtaaaacacctaaaaatagcatagtcagtcaggtatatttaactggagaaactactatgccaatgacactaaccataactttcaatggcactgatgaaaaagacacaaccccagttagcacctactctatgacttttacatggcagtggactggagactataaggacaaaaatattacctttgctaccaactcattctctttttcctacatcgcccaggaataatcccacccagcaagccaaccccttttcccaccacctttgtctatatggaaactctgaaacagaaaaataaagttcaagtgttttattgaatcaacagttttacaggactcgagcagttatttttcctccaccctcccaggacatggaatacaccaccctctccccccgcacagccttgaacatctgaatgccattggtgatggacatgcttttggtctccacgttccacacagtttcagagcgagccagtctcggatcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggttcgggtccagggactccctcagcatgatgcccacggccctcagcatcagtcgtctggtgcggcgggcgcagcagcgcatgcgaatctcgctcaggtcactgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaagacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccggatcccggcaatgacaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttctcgaccgtgtcatgatgcagttgctttcggacattttcgtacttgctgtagcagaacctggtccgggcgctgcacaccgatcgccggcggcggtctcggcgcttggaacgctcggtgttaaagttgtaaaacagccactctctcagaccgtgcagcagatctagggcctcaggagtgatgaagatcccatcatgcctgatagctctgatcacatcgaccaccgtggaatgggccaggcccagccagatgatgcaattttgttgggtttcggtgacggcgggggagggaagaacaggaagaaccatgattaacttttaatccaaacggtctcggagcacttcaaaatgaaggtcacggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaaccatcatgttacactcctgcaccatccccagataattttcatttttccagccttgaatgattcgaactagttcctgaggtaaatccaagccagccatgataaaaagctcgcgcagagcaccctccaccggcattcttaagcacaccctcataattccaagatattctgctcctggttcacctgcagcagattgacaagcggaatatcaaaatctctgccgcgatccctgagctcctccctcagcaataactgtaagtactctttcatatcgtctccgaaatttttagccataggacccccaggaataagagaagggcaagccacattacagataaaccgaagtcccccccagtgagcattgccaaatgtaagattgaaataagcatgctggctagacccggtgatatcttccagataactggacagaaaatcgggtaagcaatttttaagaaaatcaacaaaagaaaaatcttccaggtgcacgtttagggcctcgggaacaacgatggagtaagtgcaaggggtgcgttccagcatggttagttagctgatctgtaaaaaaacaaaaaataaaacattaaaccatgctagcctggcgaacaggtgggtaaatcgttctctccagcaccaggcaggccacggggtctccggcgcgaccctcgtaaaaattgtcgctatgattgaaaaccatcacagagagacgttcccggtggccggcgtgaatgattcgagaagaagcatacacccccggaacattggagtccgtgagtgaaaaaaagcggccgaggaagcaatgaggcactacaacgctcactctcaagtccagcaaagcgatgccatgcggatgaagcacaaaattttcaggtgcgtaaaaaatgtaattactcccctcctgcacaggcagcgaagctcccgatccctccagatacacatacaaagcctcagcgtccatagcttaccgagcggcagcagcagcggcac

SEQ ID NO: 3 - DNA, 32767 bp, Artificial Sequence
  Artificially Synthesized
catcatcaataatatacctcaaacttttggtgcgcgttaatatgcaaatgagctgtttgaatttggggagggaggaaggtgattggccgagagacgggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagtatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaaggctagagtacttaatacgactcactataggctagttaaggctagagttcgacgccaccatgcgcgtgatgggcatcctgcgctcctaccagcagtggtggatctggggcatcctgggcttctggatgctgatgatctgcaacgtgtggggcaacctgtgggtgaccgtgtactacggcgtgcccgtgtggaaggaggccaagaccaccctgttctgcgcctccgacgccaaggcccacaaggaggaggtgcacaacatctgggccacccacgcctgcgtgcccaccgaccccaacccccaggagatcgtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccgacgtgaagatcaagggcaccaacgccacctacaacaacgccacctacaacaacaacaacaccatctccgacatgaagaactgctccttcaacaccaccaccgagatcaccgacaagaagaagaaggagtacgccctgttctacaagctggacgtggtggccctggacggcaaggagaccaactccaccaactcctccgagtaccgcctgatcaactgcaacacctccgccgtgacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggaggtggtgatccgcttcgagaacctgaccaacaacgccaagatcatcatcgtgcacctgaacgagtccgtggagatcaactgcacccgcccctccaacaacacccgcaagtccgtgcgcatcggccccggccagaccttcttcgccaccggcgacatcatcggcgacatccgccaggcccactgcaacatctcccgcaagaagtggaacaccaccctgcagcgcgtgaaggagaagctgaaggagaagttccccaacaagaccatccagttcgccccctcctccggcggcgacctggagatcaccacccactccttcaactgccgcggcgagttcttctactgctacacctccgacctgttcaactccacctacatgtccaacaacaccggcggcgccaacatcaccctgcagtgccgcatcaagcagatcatccgcatgtggcagggcgtgggccaggccatgtacgccccccccatcgccggcaacatcacctgcaagtccaacatcaccggcctgctgctgacccgcgacggcggcaaggagaagaacgacaccgagaccttccgccccggcggcggcgacatgcgcgacaactggcgctccgagctgtacaagtacaaggtggtggagatcaagcccctgggcatcgcccccgacaaggccaagctgaccgtgcaggcccgccagctgctgtccggcatcgtgcagcagcagtccaacctgctgcgcgccatcgaggcccagcagcacatgctgcagctgaccgtgtggggcatcaagcagctgcagacccgcgtgctggccatcgagcgctacctgaaggaccagcagctgctgggcatctggggctgctccggcaagctgatctgcaccaccgccgtgccctggaacgcctcctggtccaacaagtcctacgaggagatctggggcaacatgacctggatgcagtgggaccgcgagatcaacaactacaccaacaccatctactccctgctggaggagtcccagaaccagcaggagaagaacgagaaggacctgctggccctggactcctgggagtccctgtggtcctggttcaacatcaccaactggctgtggtaaggtacctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggccagatatcgatatgctggccaccgtgcatgtgacctcgcacccccgcaagacatggcccgagttcgagcacaacgtcatgacccgatgcaatgtgcacctggggtcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcttgtatgaggggcagaatgactaaaatctgtgtttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgacttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggcgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagyccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggtcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcgggccggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggctggcataacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcagaagctcggggtcgaagtagctgatgcaggtgtccagatcgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgtgcggccttgcgcagggaggtgtgggtgagggcgaaggtgtcgcgcaccatgaccttgaggaactggtgcttgaagtcgaggtcgtcgcagccgccctgctcccagagctggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttaacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacttcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgccggtcagaagcggcggcgaggacgcgcgccgggcggcaggggcggctcgggacccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcagcgatggtggcgcgcacctcgcgctcgaaggccccggggggctcctcttcttccatctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcggggatttcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctgtatctgggtgagggtggtctggaagtcgtcgaagtcgacgaagcggtggtaggctccggtgttgatggtataggagcagttggccatgacggaccagttgacggtctggtggccgggtcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcgaccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccacctcaaccgcccctaccgccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggctatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgctcgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccgccaccaccgtgtggaagaaagagggcggggaccggcggccgtcctcggcgctgtccggtcgcgcgggtgctgccgcggcggtgcctgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcacccgtagacgccagcgacacgacaggcagcggggtctggtgtgggacgatgaggattccgccgacgacagcagcgtgttggacttgggtgggagtggtggtggtaacccgttcgctcacttgcgcccccgtatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaatggggtcgcggtggatgagaattatgatggtagtcaggacgagctgacttacgagtgggtggagtttgagctgcccgagggcaacttctcggtgaccatgaccatcgatctgatgaacaacgccatcatcgacaactacttggcggtggggcgtcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctatgagaaaagcaaggaggaggccgccgcagcggcgaccgcagccgtggccaccgcctctaccgaggtgcggggcgataattttgctagcgccgcggcagtggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgcctccaccgtggacgccgtcatcgacagcgtggtggccgatgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggtgaaggaggaaagaaagccccgcaaactgaagcgggtcaaaaaggacaaaaaggaggaggaagatgtggacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcttccaccactcgccgaagacgcaagtacggcgcggccagcctgctgatgcccaactacgcgctgcatccttccatcatccccacgccgggctaccgcggcacgcgcttctaccgcggctacaccagcagccgccgcaagaccaccacccgccgccgccgtcgtcgcacccgccgcagcagcaccgcgacttccgccgccgccctggtgcggagagtgtaccgcagcgggcgcgagcctctgaccctgccgcgcgcgcgctaccacccgagcatcgccatttaactctgccgtcgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcgggggcccagcttcaaaccctactccggcaccgcctacaacagcctggctcccaagggagcgcccaacacttgccagtggacatataaagctggtgatactgatacagaaaaaacctatacatatggaaatgcacctgtgcaaggcattagcattacaaaggatggtattcaacttggaactgacagcgatggtcaggcaatctatgcagacgaaacttatcaaccagagcctcaagtgggtgatgctgaatggcatgacatcactggtactgatgaaaaatatggaggcagagctcttaagcctgacaccaaaatgaagccttgctatggttcttttgccaagcctaccaataaagaaggaggccaggcaaatgtgaaaaccgaaacaggcggtaccaaagaatatgacattgacatggcattcttcgataatcgaagtgcagctgccgccggcctagccccagaaattgttttgtatactgagaatgtggatctggaaactccagatacccatattgtatacaaggcaggtacagatgacagtagctcttctatcaatttgggtcagcagtccatgcccaacagacccaactacattggcttcagagacaactttatcggtctgatgtactacaacagcactggcaatatgggtgtactggctggacaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaatcacggtgtggaggatgaacttcctaactattgcttccccctggatgctgtgggtagaactgatacttaccagggaattaaggccaatggtgataatcaaaccacctggaccaaagatgatactgttaatgatgctaatgaattgggcaagggcaatcctttcgccatggagatcaacatccaggccaacctgtggcggaacttcctctacgcgaacgtggcgctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgataccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagcctcttgcttcttgcaagatgacggcctgcgcgggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaatccggtgtgtgtatgtgaatgctttattcatcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccagcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcggaatgccgcggtgctcctcgttcacatacaggtggcagatacggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgttgtcatcttagtcgccgccgccgaagtcagggggtcgttctcgtccagggtctcaaacactcgcttgccgtccttctcggtgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgccgacgagaaccagcagcagcagaatgaaagcttaaccgccccgccgcccagccccacctccgacgccgcagccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcagacacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggaggaggagaaagcaagcagcacggataccatctccgctccgggtcggggtcgcggcggccgggcccacagtagatgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagcagcagaaaaccagcggcagcagctagaaaatccacagcggcggcaggtggactgaggatcgcggcgaacgagccggcgcagacccgggagctgaggaaccggatctttcccaccctctatgccatcttccagcagagtcgggggcaagagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggtctcgactcccacctgcttcggatcttcagccagcgtccgatcctggccgagcgcgagcaaggacagacccttctgaccctgtactgcatctgcaaccaccccggcctgcatgaaagtctttgttgtctgctgtgtactgagtataataaaagctgagatcagcgactactccggacttccgtgtgttcctgctatcaaccagtccctgttcttcaccgggaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgaccgcggacatgtacagagctcgagaagtactaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcaccccgaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaatatcatattgatgatgatttaaataaaaaataatcatttgatttgaaataaagatacaatcatattgatgatttgagttttaaaaaataaagaatcacttacttgaaatctgataccaggtctctgtccatgttttctgccaacaccacctcactcccctcttcccagctctggtactgcagaccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgactggctgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctctttataccaaagatggaaaattatccttacaagtttctccaccgttaaacatattaaaatcaaccattctgaacacattagctgtagcttatggatcaggtttaggactgagtggtggcactgctcttgcagtacagttggcctctccactcacttttgatgaaaaaggaaatattaaaattaacctagccagtggtccattaacagttgatgcaagtcgacttagtatcaactgcaaaagaggggtcactgtcactacctcaggagatgcaattgaaagcaacataagctggcctaaaggtataagatttgaaggtaatggcatagctgcaaacattggcagaggattggaatttggaaccactagtacagagactgatgtcacagatgcatacccaattcaagttaaattgggtactggccttacctttgacagtacaggcgccattgttgcttggaacaaagaggatgataaacttacattatggaccacagccgacccctcgccaaattgcaaaatatactctgaaaaagatgccaaactcacactttgcttgacaaagtgtggaagtcaaattctgggtactgtgactgtattggcagtgaataatggaagtctcaacccaatcacaaacacagtaagcactgcactcgtctccctcaagtttgatgcaagtggagttttgctaagcagctccacattagacaaagaatattggaacttcagaaagggagatgttacacctgctgagccctatactaatgctataggttttatgcctaacataaaggcctatcctaaaaacacatctgcagcttcaaaaagccatattgtcagtcaagtttatctcaatggggatgaggccaaaccactgatgctgattattacttttaatgaaactgaggatgcaacttgcacctacagtatcacttttcaatggaaatgggatagtactaagtacacaggtgaaacacttgctaccagctccttcaccttctcctacatcgcccaagaatgaacactgtatcccaccctgcatgccaacccttcccaccccactctgtctatggaaaaaactctgaagcacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtcccggcgcttggaacgctcggtgttgaaattgtaaaacagccactctctcagaccgtgcagcagatctagggcctcaggagtgatgaagatcccatcatgcctgatagctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaaggtcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctaagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcacccaggcaatttttaagaaaatcaacaaaagaaaaatcctccaggtgcacgtttagagcctcgggaacaacgatgaagtaaatgcaagcg

SEQ ID NO: 4 - DNA, 32767 bp, Artificial Sequence
  Artificially Synthesized
catcatcaataatatacctcaaacttttggtgcgcgttaatatgcaaatgagctgtttgaatttggggagggaggaaggtgattggccgagagacgggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaagctgcagaagttggtcgtgaggcactgggcaggtaagtatcaaggttacaagacaggtttaaggagaccaatagaaactgggcttgtcgagacagagaagactcttgcgtttctgataggcacctattggtcttactgacatccactttgcctttctctccacaggtgtccactcccagttcaattacagctcttaaggctagagtacttaatacgactcactataggctagcgccaccatgggcgccagagccagcgtgctgagcgggggagagctggatcgctgggaaaagattagactgaggcccggagggaagaaaaagtacaagctgaaacacatcgtgtgggccagcagggagctggagcgcttcgccgtgaaccccggactgctggagacctccgaaggctgtcggcagatcctggggcagctgcagccttccctgcagacaggctccgaggagctgcggtctctgtataatacagtggccacactgtactgtgtgcaccagcggattgaggtgaaggatacaaaagaggccctggagaagattgaggaggagcagaacaagagcaagaagaaagcccagcaggccgccgccgacaccggcaatagctcccaggtgagccagaactatccaattgtgcagaatctgcagggccagatggtgcaccaggccatttccccacggacactgaacgcctgggtgaaggtggtggaggagaaggccttcagccccgaagtgatccctatgttttccgccctgtccgaaggcgccacccctcaggacctgaacaccatgctgaacacagtggggggacaccaggccgccatgcagatgctgaaggaaaccatcaacgaggaggccgccgagtgggatcggctgcaccccgtgcacgccgggccaatcgcccctggccagatgagggagcccagaggctctgacatcgccggcaccacatctaccctgcaggaacagatcgggtggatgaccaataacccaccaatcccagtgggcgagatctacaagaggtggattattctgggactgaacaaaattgtgcgcatgtattcccctacatccatcctggacatcaggcagggccctaaggaacctttccgcgactacgtggatcggttctacaaaaccctgcgcgccgagcaggccagccaggaagtgaagaattggatgacagagaccctgctggtgcagaacgccaatcctgactgtaaaaccatcctgaaggccctgggccctgccgccacactggaggaaatgatgaccgcctgccagggcgtgggcggccctggccacaaagccagggtgctggccgaggccatgtctcaggtgaccaactctgccacaattatgatgcagcgggggaactttcggaaccagaggaagaccgtgaagtgcttcaactgtggcaaggagggacacatcgccaagaattgccgcgccccacggaagaaggggtgttggaaatgcgggaaggagggccaccagatgaaagactgcacagagcggcaggccaactttctgggcaagatttggcccagccacaagggccgccccggaaactttctgcagtccaggcctgagcctaccgccccccctgaggaatccttccggttcggcgaggagacaaccaccccaagccagaagcaggaacccatcgacaaagagctgtaccccctggccagcctgagatccctgttcgggaatgaccccagctctcagtgatgatctagcgtttaaacgggccctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggccagatatgctggccaccgtgcatgtgacctcgcacccccgcaagacatggcccgagttcgagcacaacgtcatgacccgatgcaatgtgcacctggggtcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcttgtatgaggggcagaatgactaaaatctgtgtttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgacttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggcgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagcccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggtcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcgggccggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggctggcataacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcagaagctcggggtcgaagtagctgatgcaggtgtccagatcgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgtgcggccttgcgcagggaggtgtgggtgagggcgaaggtgtcgcgcaccatgaccttgaggaactggtgcttgaagtcgaggtcgtcgcagccgccctgctcccagagctggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttaacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacttcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgccggtcagaagcggcggcgaggacgcgcgccgggcggcaggggcggctcgggacccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcagcgatggtggcgcgcacctcgcgctcgaaggccccggggggctcctcttcttccatctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcggggatttcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctgtatctgggtgagggtggtctggaagtcgtcgaagtcgacgaagcggtggtaggctccggtgttgatggtataggagcagttggccatgacggaccagttgacggtctggtggccgggtcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcgaccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccacctcaaccgcccctaccgccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggctatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgctcgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccgccaccaccgtgtggaagaaagagggcggggaccggcggccgtcctcggcgctgtccggtcgcgcgggtgctgccgcggcggtgcctgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcacccgtagacgccagcgacacgacaggcagcggggtctggtgtgggacgatgaggattccgccgacgacagcagcgtgttggacttgggtgggagtggtggtggtaacccgttcgctcacttgcgcccccgtatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaatggggtcgcggtggatgagaattatgatggtagtcaggacgagctgacttacgagtgggtggagtttgagctgcccgagggcaacttctcggtgaccatgaccatcgatctgatgaacaacgccatcatcgacaactacttggcggtggggcgtcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctatgagaaaagcaaggaggaggccgccgcagcggcgaccgcagccgtggccaccgcctctaccgaggtgcggggcgataattttgctagcgccgcggcagtggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgcctccaccgtggacgccgtcatcgacagcgtggtggccgatgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggtgaaggaggaaagaaagccccgcaaactgaagcgggtcaaaaaggacaaaaaggaggaggaagatgtggacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcttccaccactcgccgaagacgcaagtacggcgcggccagcctgctgatgcccaactacgcgctgcatccttccatcatccccacgccgggctaccgcggcacgcgcttctaccgcggctacaccagcagccgccgcaagaccaccacccgccgccgccgtcgtcgcacccgccgcagcagcaccgcgacttccgccgccgccctggtgcggagagtgtaccgcagcgggcgcgagcctctgaccctgccgcgcgcgcgctaccacccgagcatcgccatttaactctgccgtcgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcgggggcccagcttcaaaccctactccggcaccgcctacaacagcctggctcccaagggagcgcccaacacttgccagtggacatataaagctggtgatactgatacagaaaaaacctatacatatggaaatgcacctgtgcaaggcattagcattacaaaggatggtattcaacttggaactgacagcgatggtcaggcaatctatgcagacgaaacttatcaaccagagcctcaagtgggtgatgctgaatggcatgacatcactggtactgatgaaaaatatggaggcagagctcttaagcctgacaccaaaatgaagccttgctatggttcttttgccaagcctaccaataaagaaggaggccaggcaaatgtgaaaaccgaaacaggcggtaccaaagaatatgacattgacatggcattcttcgataatcgaagtgcagctgccgccggcctagccccagaaattgttttgtatactgagaatgtggatctggaaactccagatacccatattgtatacaaggcaggtacagatgacagtagctcttctatcaatttgggtcagcagtccatgcccaacagacccaactacattggcttcagagacaactttatcggtctgatgtactacaacagcactggcaatatgggtgtactggctggacaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaatcacggtgtggaggatgaacttcctaactattgcttccccctggatgctgtgggtagaactgatacttaccagggaattaaggccaatggtgataatcaaaccacctggaccaaagatgatactgttaatgatgctaatgaattgggcaagggcaatcctttcgccatggagatcaacatccaggccaacctgtggcggaacttcctctacgcgaacgtggcgctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgataccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagcctcttgcttcttgcaagatgacggcctgcgcgggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaatccggtgtgtgtatgtgaatgctttattcatcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccagcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcggaatgccgcggtgctcctcgttcacatacaggtggcagatacggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgttgtcatcttagtcgccgccgccgaagtcagggggtcgttctcgtccagggtctcaaacactcgcttgccgtccttctcggtgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgccgacgagaaccagcagcagcagaatgaaagcttaaccgccccgccgcccagccccacctccgacgccgcagccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcagacacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggaggaggagaaagcaagcagcacggataccatctccgctccgggtcggggtcgcggcggccgggcccacagtagatgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagcagcagaaaaccagcggcagcagctagaaaatccacagcggcggcaggtggactgaggatcgcggcgaacgagccggcgcagacccgggagctgaggaaccggatctttcccaccctctatgccatcttccagcagagtcgggggcaagagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggtctcgactcccacctgcttcggatcttcagccagcgtccgatcctggccgagcgcgagcaaggacagacccttctgaccctgtactgcatctgcaaccaccccggcctgcatgaaagtctttgttgtctgctgtgtactgagtataataaaagctgagatcagcgactactccggacttccgtgtgttcctgctatcaaccagtccctgttcttcaccgggaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgaccgcggacatgtacagagctcgagaagtactaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcaccccgaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaatatcatattgatgatgatttaaataaaaaataatcatttgatttgaaataaagatacaatcatattgatgatttgagttttaaaaaataaagaatcacttacttgaaatctgataccaggtctctgtccatgttttctgccaacaccacctcactcccctcttcccagctctggtactgcagaccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgactggctgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctctttataccaaagatggaaaattatccttacaagtttctccaccgttaaacatattaaaatcaaccattctgaacacattagctgtagcttatggatcaggtttaggactgagtggtggcactgctcttgcagtacagttggcctctccactcacttttgatgaaaaaggaaatattaaaattaacctagccagtggtccattaacagttgatgcaagtcgacttagtatcaactgcaaaagaggggtcactgtcactacctcaggagatgcaattgaaagcaacataagctggcctaaaggtataagatttgaaggtaatggcatagctgcaaacattggcagaggattggaatttggaaccactagtacagagactgatgtcacagatgcatacccaattcaagttaaattgggtactggccttacctttgacagtacaggcgccattgttgcttggaacaaagaggatgataaacttacattatggaccacagccgacccctcgccaaattgcaaaatatactctgaaaaagatgccaaactcacactttgcttgacaaagtgtggaagtcaaattctgggtactgtgactgtattggcagtgaataatggaagtctcaacccaatcacaaacacagtaagcactgcactcgtctccctcaagtttgatgcaagtggagttttgctaagcagctccacattagacaaagaatattggaacttcagaaagggagatgttacacctgctgagccctatactaatgctataggttttatgcctaacataaaggcctatcctaaaaacacatctgcagcttcaaaaagccatattgtcagtcaagtttatctcaatggggatgaggccaaaccactgatgctgattattacttttaatgaaactgaggatgcaacttgcacctacagtatcacttttcaatggaaatgggatagtactaagtacacaggtgaaacacttgctaccagctccttcaccttctcctacatcgcccaagaatgaacactgtatcccaccctgcatgccaacccttcccaccccactctgtctatggaaaaaactctgaagcacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtcccggcgcttggaacgctcggtgttgaaattgtaaaacagccactctctcagaccgtgcagcagatctagggcctcaggagtgatgaagatcccatcatgcctgatagctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaaggtcgcggagatggcacctctcgcccccgctgtgttggtggaaaataacagccaggtcaaaggtgatacggttctcgagatgttccacggtggcttccagcaaagcctccacgcgcacatccagaaacaagacaatagcgaaagcgggagggttctctaattcctcaatcatcatgttacactcctgcaccatccccagataattttcatttttccagccttgaatgattcgaactagttcctgaggtaaatccaagccagccatgataaagagctcgcgcagagcgccctccaccggcattcttaagcacaccctcataattccaagatattctgctcctggttcacctgcagcagattgacaagcggaatatcaaaatctctgccgcgatccctaagctcctccctcagcaataactgtaagtactctttcatatcctctccgaaatttttagccataggaccaccaggaataagattagggcaagccacagtacagataaaccgaagtcctccccagtgagcattgccaaatgcaagactgctataagcatgctggctagacccggtgatatcttccagataactggacagaaaatcacccaggcaatttttaagaaaatcaacaaaagaaaaatcctccaggtgcacgtttagagcctcgggaacaacgatgaagtaaatgcaagcggtgcgtt

SEQ ID NO: 5 - DNA, 32767 bp, Artificial Sequence
  Artificially Synthesized
catcatcaataatatacctcaaacttttggtgcgcgttaatatgcaaatgagctgtttgaatttggggagggaggaaggtgattggctgcgggagcggcgaccgttaggggcggggcgggtgacgttttgatgacgtggctatgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagtatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaaggctagagtacttaatacgactcactataggctagttaaggctagagttcgacgccaccatgcgcgtgatgggcatcctgcgctcctaccagcagtggtggatctggggcatcctgggcttctggatgctgatgatctgcaacgtgtggggcaacctgtgggtgaccgtgtactacggcgtgcccgtgtggaaggaggccaagaccaccctgttctgcgcctccgacgccaaggcccacaaggaggaggtgcacaacatctgggccacccacgcctgcgtgcccaccgaccccaacccccaggagatcgtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccgacgtgaagatcaagggcaccaacgccacctacaacaacgccacctacaacaacaacaacaccatctccgacatgaagaactgctccttcaacaccaccaccgagatcaccgacaagaagaagaaggagtacgccctgttctacaagctggacgtggtggccctggacggcaaggagaccaactccaccaactcctccgagtaccgcctgatcaactgcaacacctccgccgtgacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggaggtggtgatccgcttcgagaacctgaccaacaacgccaagatcatcatcgtgcacctgaacgagtccgtggagatcaactgcacccgcccctccaacaacacccgcaagtccgtgcgcatcggccccggccagaccttcttcgccaccggcgacatcatcggcgacatccgccaggcccactgcaacatctcccgcaagaagtggaacaccaccctgcagcgcgtgaaggagaagctgaaggagaagttccccaacaagaccatccagttcgccccctcctccggcggcgacctggagatcaccacccactccttcaactgccgcggcgagttcttctactgctacacctccgacctgttcaactccacctacatgtccaacaacaccggcggcgccaacatcaccctgcagtgccgcatcaagcagatcatccgcatgtggcagggcgtgggccaggccatgtacgccccccccatcgccggcaacatcacctgcaagtccaacatcaccggcctgctgctgacccgcgacggcggcaaggagaagaacgacaccgagaccttccgccccggcggcggcgacatgcgcgacaactggcgctccgagctgtacaagtacaaggtggtggagatcaagcccctgggcatcgcccccgacaaggccaagcgccgcgtggtggagcgcgagaagcgcgccgtgggcatcggcgccgtgttcctgggcttcctgggcgccgccggcagcaccatgggcgccgccagcatgaccctgaccgtgcaggcccgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgaaggaccagcagctgctgggcatctggggctgcagcggcaagctgatctgcaccaccgccgtgccctggaacgccagctggagcaacaagagctacgaggagatctggggcaacatgacctggatgcagtgggaccgcgagatcaacaactacaccaacaccatctacagcctgctggaggagagccagaaccagcaggagaagaacgagaaggacctgctggccctggacagctgggagagcctgtggagctggttcaacatcaccaactggctgtggtacatccgcatcttcatcatcatcgtgggcggcctgatcggcctgcgcatcatcttcgccgtgctgagcatcgtgaaccgcgtgcgccagggctacagccccctgagcttccagaccctgacccccagcccccgcgagcccgaccgcctgggccgcatcgaggaggagggcggcgagcaggaccgcgcccgcagcgtgcgcctggtgaacggcttcctggccctggcctgggaggacctgcgcagcctgtgcctgttcagctaccaccgcctgcgcgacctgatcctgatcgccgcccgcgccgccgccctgctgggccgcagcagcctgtggggcctgcagaagggctgggaggccctgaagtacctgggcagcctggtgcagtactggggcctggagctgaagaagagcgccatcagcctgttcgacgccatcgccatcaccgtggccgagggcaccgaccgcatcatcaacatcgtgcagcgcatcagccgcgccttctacaacatcccccgccgcatccgccagggcttcgaggccaccctgcagtaaggtacctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggtcagatatcgacatatgctggccaccgtgcatgtggcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttggggctgggtgtgagcctgcatgaggggcagaatgactaaaatctgtggttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcggggatggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcaaccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatttggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagattgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctttggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttaggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgttggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttggcgaggaatttcagtgggcagtggagcgctggcggctgcatctcgtgctgtactacgtcttggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggctacgtccacggcttgcagggtgccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgttccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcttccatctcctcctcttcctcctccactaacatctcttctacttcctcctcaggaggcggtggcgggggaggggccctgcgtcgccggcggcgcacgggcagacggtcgatgaagcgctcgatggtctccccgcgccggcgacgcatggtctcggtgacggcgcgcccgtcctcgcggggccgcagcatgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggtgaggatggcctgctggatctgggtgagggtggtctggaagtcgtcgaagtcgacgaagcggtggtaggctccggtgttgatggtgtaggagcagttggccatgacggaccagttgacggtctggtggccgggtcgcacgagctcgtggtacttgaggcgcgagtaggcgcgcgtgtcgaagatgtagtcgttgcaggcgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcggccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttttttcttgtgtttttgccagatgcatcccgtactgcggcagatgcgcccccaccctccaccacaaccgcccctaccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattttgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggtgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcggacaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgcggcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgtccaggaaccaatgccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcgaccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcgcaggcacccgtagacgccagcggcacgacaggcagcggggactggtgtgggacgatgaggattccgccgacgacagcagcgtgttggacttgggtgggagtggtggtaacccgttcgctcacctgcgcccccgtatcgggcgcctgatgtaagaatctgaaaaaataaaagacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcagacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtggatgatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcaccgccgcggcgaccgcagccgtggccaccgcctctaccgaggtgcggggcgataattttgctagcgctgcggcagcggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcaccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcgtacggcaagcgcagccgccccgcgcccttgaaagaggaggcggtgtccatcccgctggaccacggcaaccccacgccgagcctgaagccggtgaccctgcagcaggtgctaccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccagcaccagcttccaccagcactcgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgtcgtcgcagccgccgcagcagcaccgcgacttccgccttggtgcggagagtgtatcgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacaaaaaagcatggatttgtaataaaaaaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagaacagaacttccagcagaaggtggttgatggcctggcctcaggcatcaacggggtggttgacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggcctgcccaccacgcggcccgtggcgcctctggccaccggagtgctgaaacccagcagcagccagcccgcgaccctggacttgcctccgcctcgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggagtgtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactctggcaccgcctacaacagcctagctcccaagggagctcccaattccagccagtgggagcaagcaaaaacaggcaatgggggaactatggaaacacacacatatggtgtggccccaatgggcggagagaatattacaaaagatggtcttcaaattggaactgacgttacagcgaatcagaataaaccaatttatgccgacaaaacatttcaaccagaaccgcaagtaggagaagaaaattggcaagaaactgaaaacttttatggcggtagagctcttaaaaaagacacaaacatgaaaccttgctatggctcctatgctagacccaccaatgaaaaaggaggtcaagctaaacttaaagttggagatgatggagttccaaccaaagaattcgacatagacctggctttctttgatactcccggtggcaccgtgaacggtcaagacgagtataaagcagacattgtcatgtataccgaaaacacgtatttggaaactccagacacgcatgtggtatacaaaccaggcaaggatgatgcaagttctgaaattaacctggttcagcagtctatgcccaacagacccaactacattgggttcagggacaactttatcggtcttatgtactacaacagcactggcaatatgggtgtgcttgctggtcaggcctcccagctgaatgctgtggttgatttgcaagacagaaacaccgagctgtcctaccagctcttgcttgactctttgggtgacagaacccggtatttcagtatgtggaaccaggcggtggacagttatgaccccgatgtgcgcatcatcgaaaaccatggtgtggaggatgaattgccaaactattgcttccccttggacggctctggcactaacgccgcataccaaggtgtgaaagtaaaagatggtcaagatggtgatgttgagagtgaatgggaaaatgacgatactgttgcagctcgaaatcaattatgtaaaggtaacattttcgccatggagattaatctccaggctaacctgtggagaagtttcctctactcgaacgtggccctgtacctgcccgactcctacaagtacacgccgaccaacgtcacgctgccgaccaacaccaacacctacgattacatgaatggcagagtgacacctccctcgctggtagacgcctacctcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctaggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctgaagacccgcgagacgccctcgctcggctccgggttcgacccctacttcgtctactcgggctccatcccctacctagacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaagccgtctacctgcgcacgcccttctcggccggcaacgccaccacctaagccgctcttgcttcttgcaagatgacggcgggctccggcgagcaggagctcagggccatcctccgcgacctgggctgcgggccctgcttcctgggcaccttcgacaagcgcttccctggattcatggccccgcacaagctggcctgcgccatcgtgaacacggccggccgcgagaccgggggcgagcactggctggccttcgcctggaacccgcgctcccacacatgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaagcgctctaccgcttcctcaatgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccggcgtcgtgcacgcagcagcgcgcgtcgttgttggccagctgcaccacgctgcgcccccagcggttctgggtgatcttggcccggttggggttctccttcagcgcgcgctgcccgttctcgctcgccacatccatctcgatagtgtgctccttctggatcatcacggtcccgtgcaggcaccgcagcttgccctcggcttcggtgcagccgtgcagccacagcgcgcagccggtgcactcccagttcttgtgggcgatctgggagtgcgagtgcacgaagccctgcaggaagcggcccatcatcgcggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcgatgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggagagcgcgagttctcgttcaccacgactatttcttcttcttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaacaacaagcatggagactcagccatcgtcgccaacatcgccatctgcccccgccgccaccgccgacgagaaccagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagaacgagcagaaccaggctgggcacgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgtgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagttcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctggagtgccactgccgctgcaacctctgcacgccgcaccgctccctggcctgcaacccccagctgctgagcgagacccagatcatcggcaccttcgagttgcaaggccccggcgacggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagaaaaccagcggcagcagcagctagaaaatccacagcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccagcccacggagtgcggatcatcgtcgaagggggcctcgactcccacctgcttcggatcttcagccagcgaccgatcctggtcgagcgcgaacaaggacagacccttcttactttgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcaggaccctgccatcacaccttccacctgatcccgaataccacagcgccgctccccgctactaacaaccaaactacccaccaacgccaccgtcgcgacctttcctctgaatctaataccactaccggaggtggcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgatttaaataaaaaaaataatcatttgatttgaaataaagatacaatcatattgatgatttgagtttaacaaaaataaagaatcacttacttgaaatctgataccaggtctctgtccatgttttctgccaacaccacctcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggctgaccccgtcaccaccaagaacggggaaatcaccctcaagctgggagagggggtggacctcgactcgtcgggaaaactcatctccaacacggccaccaaggccgccgcccctctcagtatttcaaacaacaccatttcccttaaaactgctgcccctttctacaacaacaatggaactttaagcctcaatgtctccacaccattagcagtatttcccacatttaacactttaggcataagtcttggaaacggtcttcagacttcaaataagttgttgactgtacaactaactcatcctcttacattcagctcaaatagcatcacagtaaaaacagacaaagggctatatattaactccagtggaaacagaggacttgaggctaatataagcctaaaaagaggactagtttttgacggtaatgctattgcaacatatattggaaatggcttagactatggatcttatgatagtgatggaaaaacaagacccgtaattaccaaaattggagcaggattaaattttgatgctaacaaagcaatagctgtcaaactaggcacaggtttaagttttgactccgctggtgccttgacagctggaaacaaacaggatgacaagctaacactttggactacccctgacccaagccctaattgtcaattactttcagacagagatgccaaatttactctctgtcttacaaaatgcggtagtcaaatactaggcactgtggcagtggcggctgttactgtaggatcagcactaaatccaattaatgacacagtcaaaagcgccatagttttccttagatttgattccgatggtgtactcatgtcaaactcatcaatggtaggtgattactggaactttagggagggacagaccactcaaagtgtagcctatacaaatgctgtgggattcatgccaaatataggtgcatatccaaaaacccaaagtaaaacacctaaaaatagcatagtcagtcaggtatatttaactggagaaactactatgccaatgacactaaccataactttcaatggcactgatgaaaaagacacaaccccagttagcacctactctatgacttttacatggcagtggactggagactataaggacaaaaatattacctttgctaccaactcattctctttttcctacatcgcccaggaataatcccacccagcaagccaaccccttttcccaccacctttgtctatatggaaactctgaaacagaaaaataaagttcaagtgttttattgaatcaacagttttacaggactcgagcagttatttttcctccaccctcccaggacatggaatacaccaccctctccccccgcacagccttgaacatctgaatgccattggtgatggacatgcttttggtctccacgttccacacagtttcagagcgagccagtctcggatcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggttcgggtccagggactccctcagcatgatgcccacggccctcagcatcagtcgtctggtgcggcgggcgcagcagcgcatgcgaatctcgctcaggtcactgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaagacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccggatcccggcaatgacaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttctcgaccgtgtcatgatgcagttgctttcggacattttcgtacttgctgtagca

SEQ ID NO: 6 - DNA, 32767 bp, Artificial Sequence
  Artificially Synthesized
catcatcaataatatacctcaaacttttggtgcgcgttaatatgcaaatgagctgtttgaatttggggagggaggaaggtgattggctgcgggagcggcgaccgttaggggcggggcgggtgacgttttgatgacgtggctatgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagtatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaaggctagagttcgacgccaccatgcgcgtgcgcggcatcccccgcaactggccccagtggtggatctggggcatcctgggcttctggatgatcatcatctgccgcgtggtgggcaacctggacctgtgggtgaccgtgtactacggcgtgcccgtgtggaaggaggccaagaccaccctgttctgcgcctccgacgccaaggcctacgacaaggaggtgcacaacgtgtgggccacccacgcctgcgtgcccaccgaccccaacccccaggagatcgtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgcaagaacgtgaacatctccgccaacgccaacgccaccgccaccctgaactcctccatgaacggcgagatcaagaactgctccttcaacaccaccaccgagctgcgcgacaagaagcagaaggtgtacgccctgttctacaagcccgacgtggtgcccctgaacggcggcgagcacaacgagaccggcgagtacatcctgatcaactgcaactcctccaccatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggagatcatcgtgcgctccgagaacctgaccaacaacatcaagaccatcatcgtgcacctgaacaagtccgtggagatcaagtgcacccgccccaacaacaacacccgcaagtccgtgcgcatcggccccggccagaccttctacgccaccggcgagatcatcggcgacatccgcgaggcccactgcaacatctcccgcgagacctggaactccaccctgatccaggtgaaggagaagctgcgcgagcactacaacaagaccatcaagttcgagccctcctccggcggcgacctggaggtgaccacccactccttcaactgccgcggcgagttcttctactgcgacaccaccaagctgttcaacgagaccaagctgttcaacgagtccgagtacgtggacaacaagaccatcatcctgccctgccgcatcaagcagatcatcaacatgtggcaggaggtgggccgcgccatgtacgccccccccatcgagggcaacatcacctgcaagtccaacatcaccggcctgctgctgacctgggacggcggcgagaactccaccgagggcgtgttccgccccggcggcggcaacatgaaggacaactggcgctccgagctgtacaagtacaaggtggtggagatcaagcccctgggcgtggcccccaccaagagcaagcgcaaggtggtgggccgcgagaagcgcgccgtgggcctgggcgccgtgctgctgggcttcctgggcgccgccggcagcaccatgggcgccgccagcatcaccctgaccgtgcaggcccgccagctgctgagcggcatcgtgcagcagcagagcaacctgctgcgcgccatcgaggcccagcagcacctgctgcagctgaccgtgtggggcatcaagcagctgcagacccgcgtgctggccatcgagcgctacctgaaggaccagcagctgctgggcctgtggggctgcagcggcaagctgatctgcgccaccgccgtgccctggaacagcagctggagcaacaagagcctgggcgacatctgggacaacatgacctggatgcagtgggaccgcgagatcagcaactacaccaacaccatcttccgcctgctggaggacagccagaaccagcaggagaagaacgagaaggacctgctggccctggacagctggaagaacctgtggaactggttcgacatcaccaactggctgtggtacatcaagatcttcatcatgatcgtgggcggcctgatcggcctgcgcatcatcttcggcgtgctggccatcgtgaagcgcgtgcgccagggctacagccccctgagcttccagaccctgatccccaacccccgcggccccgaccgcctgggccgcatcgaggaggagggcggcgagcaggacaaggaccgcagcatccgcctggtgagcggcttcctggccctggcctgggacgacctgcgcagcctgtgcctgttcagctaccaccagctgcgcgacttcatcctgaccgccgcccgcgccgccgagctgctgggccgcagcagcctgcgcggcctgcagcgcggctgggaggtgctgaagtacctgggcaacctggtgcagtactggggcctggagctgaagcgcagcgccatcaacctgttcgacaccatcgccatcgccgtggccgagggcaccgaccgcatcatcgaggtgatccagcgcatctgccgcgccatccgctacatccccacccgcatccgccagggcttcgaggccgccctgctgtaaggtacctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggtcagatatcgacatatgctggccaccgtgcatgtggcctcgcacccccgcaagacatggcccgagttcgagcacaacgtcatgacccgctgcaatgtgcacctgggctcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttggggctgggtgtgagcctgcatgaggggcagaatgactaaaatctgtggttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgagttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggatcttttccaggacccggtagaggtgggcttggatgttgaggtacatgggcatgagcccgtcccgggggtggaggtagctccattgcagggcctcgtgctcggggatggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggtgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcaaccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagtccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggccgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcggggcggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggcgggcatgacctcggcactcaggttgtcagtttctagaaacgaggaggatttgatattgacggtgccgttggagacgcctttcatgagcccctcgtccatttggtcagaaaagacgatctttttgttgtcgagcttggtggcgaaggagccgtagagggcgttggagagcagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcaggagctcggggtcgaagtagctgatgcaggtgcccagattgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctttggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcatacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgcgcggccttgcgcagggaggtgtgggtgagggcgaaggtgtcgcgcaccatgaccttgaggaactggtgcttgaagtcgaggtcgtcgcagccgccctgctcccagagttggaagtccgtgcgcttcttgtaggcggggttaggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttgacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgttggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttggcgaggaatttcagtgggcagtggagcgctggcggctgcatctcgtgctgtactacgtcttggccatcggcgtggccatcgtctgcctcgatggtggtcatgctgacgagcccgcgcgggaggcaggtccagacctcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggctacgtccacggcttgcagggtgccgtgcccctggggcgccaccaccgtgccccgtttcttcttgggcgctgcttccatgtcggtcagaagcggcggcgaggacgcgcgccgggcggcaggggcggctcggggcccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgttccatggcctcgtagaagtccacggcgaagttgaaaaactgggagttgcgcgccgagacggtcaactcctcctccagaagacggatgagctcggcgatggtggcgcgcacctcgcgctcgaaggccccggggggctcctcttccatctcctcctcttcctcctccactaacatctcttctacttcctcctcaggaggcggtggcgggggaggggccctgcgtcgccggcggcgcacgggcagacggtcgatgaagcgctcgatggtctccccgcgccggcgacgcatggtctcggtgacggcgcgcccgtcctcgcggggccgcagcatgaagacgccgccgcgcatctccaggtggccgccgggggggtctccgttgggcagggagagggcgctgacgatgcatcttatcaattgacccgtagggactccgcgcaaggacctgagcgtctcgagatccacgggatccgaaaaccgctgaacgaaggcttcgagccagtcgcagtcgcaaggtaggctgagcccggtttcttgttcttcgggtatttggtcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctgcggctggacgagcgccaggtcggcgacgacgcgctcggtgaggatggcctgctggatctgggtgagggtggtctggaagtcgtcgaagtcgacgaagcggtggtaggctccggtgttgatggtgtaggagcagttggccatgacggaccagttgacggtctggtggccgggtcgcacgagctcgtggtacttgaggcgcgagtaggcgcgcgtgtcgaagatgtagtcgttgcaggcgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcggccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttttttcttgtgtttttgccagatgcatcccgtactgcggcagatgcgcccccaccctccaccacaaccgcccctaccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattttgcagagcatcgtggtgcaggagcgcgggctgccgctgtccgagaagctggcggccatcaacttctcggtgctgagtctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgccgccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggtgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcggacaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgcggcgctcgacatgaccgcgcgcaacatggagcccagcatgtacgcccgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgtccaggaaccaatgccgtgtggaagaaagagggcggggaccggcggccgtcctcggcgctgtccggtcgcgcgggtgctgccgcggcggtgcccgaggccgccagccccttcccgagcctgcccttttcgctgaacagcgtgcgcagcagcgagctgggtcggctgacgcgaccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcgcaggcacccgtagacgccagcggcacgacaggcagcggggactggtgtgggacgatgaggattccgccgacgacagcagcgtgttggacttgggtgggagtggtggtaacccgttcgctcacctgcgcccccgtatcgggcgcctgatgtaagaatctgaaaaaataaaagacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcagacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaacggggtggatgatgattatgatggtagtcaggacgagctgacctacgagtgggtggagtttgagctgcccgagggcaacttctcggtgaccatgaccatcgatctgatgaacaacgccatcatcgacaactacttggcggtggggcggcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctacgagaaaagcaaggaggatagcaccgccgcggcgaccgcagccgtggccaccgcctctaccgaggtgcggggcgataattttgctagcgctgcggcagcggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgtctccaccgtggacgccgtcatcgacagcgtggtggccgacgcgcgccggtacgcccgcaccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggcggcggtgaaggaggaaagaaagccccgcaaactgaagcgggtcaaaaaggacaaaaaggaggaggaagatgacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcgtacggcaagcgcagccgccccgcgcccttgaaagaggaggcggtgtccatcccgctggaccacggcaaccccacgccgagcctgaagccggtgaccctgcagcaggtgctaccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccagcaccagcttccaccagcactcgccgaagacgcaagtacggcgcggccagcctgctgatgcccaactacgcgctgcatccttccatcatccccacgccgggctaccgcggcacgcgcttctaccgcggctacaccagcagccgccgccgcaagaccaccacccgccgccgtcgtcgcagccgccgcagcagcaccgcgacttccgccttggtgcggagagtgtatcgcagcgggcgcgagcctctgaccctgccgcgcgcgcgctaccacccgagcatcgccatttaactaccgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacaaaaaagcatggatttgtaataaaaaaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagaacagaacttccagcagaaggtggttgatggcctggcctcaggcatcaacggggtggttgacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggcctgcccaccacgcggcccgtggcgcctctggccaccggagtgctgaaacccagcagcagccagcccgcgaccctggacttgcctccgcctcgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggagtgtgaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggaccggggccctagcttcaaaccctactctggcaccgcctacaacagcctagctcccaagggagctcccaattccagccagtgggagcaagcaaaaacaggcaatgggggaactatggaaacacacacatatggtgtggccccaatgggcggagagaatattacaaaagatggtcttcaaattggaactgacgttacagcgaatcagaataaaccaatttatgccgacaaaacatttcaaccagaaccgcaagtaggagaagaaaattggcaagaaactgaaaacttttatggcggtagagctcttaaaaaagacacaaacatgaaaccttgctatggctcctatgctagacccaccaatgaaaaaggaggtcaagctaaacttaaagttggagatgatggagttccaaccaaagaattcgacatagacctggctttctttgatactcccggtggcaccgtgaacggtcaagacgagtataaagcagacattgtcatgtataccgaaaacacgtatttggaaactccagacacgcatgtggtatacaaaccaggcaaggatgatgcaagttctgaaattaacctggttcagcagtctatgcccaacagacccaactacattgggttcagggacaactttatcggtcttatgtactacaacagcactggcaatatgggtgtgcttgctggtcaggcctcccagctgaatgctgtggttgatttgcaagacagaaacaccgagctgtcctaccagctcttgcttgactctttgggtgacagaacccggtatttcagtatgtggaaccaggcggtggacagttatgaccccgatgtgcgcatcatcgaaaaccatggtgtggaggatgaattgccaaactattgcttccccttggacggctctggcactaacgccgcataccaaggtgtgaaagtaaaagatggtcaagatggtgatgttgagagtgaatgggaaaatgacgatactgttgcagctcgaaatcaattatgtaaaggtaacattttcgccatggagattaatctccaggctaacctgtggagaagtttcctctactcgaacgtggccctgtacctgcccgactcctacaagtacacgccgaccaacgtcacgctgccgaccaacaccaacacctacgattacatgaatggcagagtgacacctccctcgctggtagacgcctacctcaacatcggggcgcgctggtcgctggaccccatggacaacgtcaaccccttcaaccaccaccgcaacgcgggcctgcgctaccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctaggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggatggtccttcacgcgcctgaagacccgcgagacgccctcgctcggctccgggttcgacccctacttcgtctactcgggctccatcccctacctagacggcaccttctacctcaaccacaccttcaagaaggtctccatcaccttcgactcctccgtcagctggcccggcaacgaccgcctcctgacgcccaacgagttcgaaatcaagcgcaccgtcgacggagagggatacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaagccgtctacctgcgcacgcccttctcggccggcaacgccaccacctaagccgctcttgcttcttgcaagatgacggcgggctccggcgagcaggagctcagggccatcctccgcgacctgggctgcgggccctgcttcctgggcaccttcgacaagcgcttccctggattcatggccccgcacaagctggcctgcgccatcgtgaacacggccggccgcgagaccgggggcgagcactggctggccttcgcctggaacccgcgctcccacacatgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttactgacgggggtgcccaacggcatgctccagtcgccccaggtggaacccaccctgcgccgcaaccaggaagcgctctaccgcttcctcaatgcccactccgcctactttcgctcccaccgcgcgcgcatcgagaaggccaccgccttcgaccgcatgaatcaagacatgtaaaaaaccggtgtgtgtatgtgaatgctttattcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttgggcacggggaggtcggggaacgagtcgctccacagcttgcgcgtgagttgcagggcgcccagcaggtcgggcgcggagatcttgaaatcgcagttgggacccgcgttctgcgcgcgagagttgcggtacacggggttgcagcactggaacaccatcagggccgggtgcttcacgcttgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccggcgtcgtgcacgcagcagcgcgcgtcgttgttggccagctgcaccacgctgcgcccccagcggttctgggtgatcttggcccggttggggttctccttcagcgcgcgctgcccgttctcgctcgccacatccatctcgatagtgtgctccttctggatcatcacggtcccgtgcaggcaccgcagcttgccctcggcttcggtgcagccgtgcagccacagcgcgcagccggtgcactcccagttcttgtgggcgatctgggagtgcgagtgcacgaagccctgcaggaagcggcccatcatcgcggtcagggtcttgttgctggtgaaggtcagcgggatgccgcggtgctcctcgttcacatacaggtggcagatgcggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgccattgtcatcttagtcgccgccgccgaggtcagggggtcgttctcgtccagggtctcaaacactcgcttgccgtccttctcgatgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcgatgtgctgggagagcgcgagttctcgttcaccacgactatttcttcttcttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaacaacaagcatggagactcagccatcgtcgccaacatcgccatctgcccccgccgccaccgccgacgagaaccagcagcagaatgaaagcttaaccgccccgccgcccagccccacctccgacgccgcggccccagacatgcaagagatggaggaatccatcgagattgacctgggctacgtgacgcccgcggagcacgaggaggagctggcagcgcgcttttcagccccggaagagaaccaccaagagcagccagagcaggaagcagagaacgagcagaaccaggctgggcacgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgtgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcacctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagttcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttctttgccgacgcggagaccctgcgcaaggtcgaggagaacctgcactacctcttcaggcacgggttcgtgcgccaggcctgcaagatctccaacgtggagctgaccaacctggtctcctacatgggcatcctgcacgagaaccgcctggggcaaaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgtaccaccgcctcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacttgctgcgcctggccaactacctggcctaccactcggacgtgatcgaggacgtcagcggcgagggtctgctggagtgccactgccgctgcaacctctgcacgccgcaccgctccctggcctgcaacccccagctgctgagcgagacccagatcatcggcaccttcgagttgcaaggccccggcgacggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggagaaagcaagcagcacggataccatctccgctccgggtcggggtcgcggcggccgggcccacagtaggtgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagaaaaccagcggcagcagcagctagaaaatccacagcggcggcaggtggactgaggatcgcggcgaacgagccggcgcagacccgggagctgaggaaccggatctttcccaccctctatgccatcttccagcagagtcgggggcaggagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggcggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcagctgacctagctcggcttcgacacctggaccactgccgccgcttccgctgcttcgctcgggatctcgccgagtttgcctactttgagctgcccgaggagcaccctcagggcccagcccacggagtgcggatcatcgtcgaagggggcctcgactcccacctgcttcggatcttcagccagcgaccgatcctggtcgagcgcgaacaaggacagacccttcttactttgtactgcatctgcaaccaccccggcctgcatgaaagtctttgttgtctgctgtgtactgagtataataaaagctgagatcagcgactactccggactcgattgtggtgttcctgctatcaaccggtccctgttcttcaccgggaacgagaccgagctccagctccagtgtaagccccacaagaagtacctcacctggctgttccagggctccccgatcgccgttgtcaaccactgcgacaacgacggagtcctgctgagcggccctgccaaccttactttttccacccgcagaagcaagctccagctcttccaacccttcctccccgggacctatcagtgcgtctcaggaccctgccatcacaccttccacctgatcccgaataccacagcgccgctccccgctactaacaaccaaactacccaccaacgccaccgtcgcgacctttcctctgaatctaataccactaccggaggtggcttctgctgttagtgctcccccgtcccgtcgacccccggtcccccactcagtcccccgaggaggttcgcaaatgcaaattccaagaaccctggaaattcctcaaatgctaccgccaaaaatcagacatgcatcccagctggatcatgatcattgggatcgtgaacattctggcctgcaccctcatctcctttgtgatttacccctgctttgactttggttggaactcgccagaggcgctctatctcccgcctgaacctgacacaccaccacagcagcaacctcaggcacacgcactaccaccaccacagcctaggccacaatacatgcccatattagactatgaggccgagccacagcgacccatgctccccgctattagttacttcaatctaaccggcggagatgactgacccactggccaataacaacgtcaacgaccttctcctggacatggacggccgcgcctcggagcagcgactcgcccaacttcgcattcgtcagcagcaggagagagccgtcaaggagctgcaggacggcatagccatccaccagtgcaagagaggcatcttctgcctggtgaaacaggccaagatctcctacgaggtcacccagaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaagatcatattgatgatgatttaaataaaaaaaataatcatttgatttgaaataaagatacaatcatattgatgatttgagtttaacaaaaataaagaatcacttacttgaaatctgataccaggtctctgtccatgttttctgccaacaccacctcactcccctcttcccagctctggtactgcaggccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgttgtccctgcgactggctgaccccgtcaccaccaagaacggggaaatcaccctcaagctgggagagggggtggacctcgactcgtcgggaaaactcatctccaacacggccaccaaggccgccgcccctctcagtatttcaaacaacaccatttcccttaaaactgctgcccctttctacaacaacaatggaactttaagcctcaatgtctccacaccattagcagtatttcccacatttaacactttaggcataagtcttggaaacggtcttcagacttcaaataagttgttgactgtacaactaactcatcctcttacattcagctcaaatagcatcacagtaaaaacagacaaagggctatatattaactccagtggaaacagaggacttgaggctaatataagcctaaaaagaggactagtttttgacggtaatgctattgcaacatatattggaaatggcttagactatggatcttatgatagtgatggaaaaacaagacccgtaattaccaaaattggagcaggattaaattttgatgctaacaaagcaatagctgtcaaactaggcacaggtttaagttttgactccgctggtgccttgacagctggaaacaaacaggatgacaagctaacactttggactacccctgacccaagccctaattgtcaattactttcagacagagatgccaaatttactctctgtcttacaaaatgcggtagtcaaatactaggcactgtggcagtggcggctgttactgtaggatcagcactaaatccaattaatgacacagtcaaaagcgccatagttttccttagatttgattccgatggtgtactcatgtcaaactcatcaatggtaggtgattactggaactttagggagggacagaccactcaaagtgtagcctatacaaatgctgtgggattcatgccaaatataggtgcatatccaaaaacccaaagtaaaacacctaaaaatagcatagtcagtcaggtatatttaactggagaaactactatgccaatgacactaaccataactttcaatggcactgatgaaaaagacacaaccccagttagcacctactctatgacttttacatggcagtggactggagactataaggacaaaaatattacctttgctaccaactcattctctttttcctacatcgcccaggaataatcccacccagcaagccaaccccttttcccaccacctttgtctatatggaaactctgaaacagaaaaataaagttcaagtgttttattgaatcaacagttttacaggactcgagcagttatttttcctccaccctcccaggacatggaatacaccaccctctccccccgcacagccttgaacatctgaatgccattggtgatggacatgcttttggtctccacgttccacacagtttcagagcgagccagtctcggatcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggttcgggtccagggactccctcagcatgatgcccacggccctcagcatcagtcgtctggtgcggcgggcgcagcagcgcatgcgaatctcgctcaggtcactgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaagacgctgcccatgtacatgatctccttgggcatgtggcggttcaccacctcccggtaccacatcaccctctggttgaacatgcagccccggatgatcctgcggaaccacagggccagcaccgccccgcccgccatgcagcgaagagaccccggatcccggcaatgacaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttctcgaccgtgtcatgatgcagttgctttcggacattttcgtacttgctgtagcagaacctggtccgggcgctgcacaccgatcgccggcggcggtctcg

SEQ ID NO: 7 - DNA, 32767 bp, Artificial Sequence
  Artificially Synthesized
catcatcaataatatacctcaaacttttggtgcgcgttaatatgcaaatgagctgtttgaatttggggagggaggaaggtgattggccgagagacgggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagtatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaaggctagagtacttaatacgactcactataggctagttaaggctagagttcgacgccaccatgcgcgtgatgggcatcctgcgctcctaccagcagtggtggatctggggcatcctgggcttctggatgctgatgatctgcaacgtgtggggcaacctgtgggtgaccgtgtactacggcgtgcccgtgtggaaggaggccaagaccaccctgttctgcgcctccgacgccaaggcccacaaggaggaggtgcacaacatctgggccacccacgcctgcgtgcccaccgaccccaacccccaggagatcgtgctgaagaacgtgaccgagaacttcaacatgtggaagaacgacatggtggaccagatgcacgaggacatcatctccctgtgggaccagtccctgaagccctgcgtgaagctgacccccctgtgcgtgaccctgaactgctccgacgtgaagatcaagggcaccaacgccacctacaacaacgccacctacaacaacaacaacaccatctccgacatgaagaactgctccttcaacaccaccaccgagatcaccgacaagaagaagaaggagtacgccctgttctacaagctggacgtggtggccctggacggcaaggagaccaactccaccaactcctccgagtaccgcctgatcaactgcaacacctccgccgtgacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggaggtggtgatccgcttcgagaacctgaccaacaacgccaagatcatcatcgtgcacctgaacgagtccgtggagatcaactgcacccgcccctccaacaacacccgcaagtccgtgcgcatcggccccggccagaccttcttcgccaccggcgacatcatcggcgacatccgccaggcccactgcaacatctcccgcaagaagtggaacaccaccctgcagcgcgtgaaggagaagctgaaggagaagttccccaacaagaccatccagttcgccccctcctccggcggcgacctggagatcaccacccactccttcaactgccgcggcgagttcttctactgctacacctccgacctgttcaactccacctacatgtccaacaacaccggcggcgccaacatcaccctgcagtgccgcatcaagcagatcatccgcatgtggcagggcgtgggccaggccatgtacgccccccccatcgccggcaacatcacctgcaagtccaacatcaccggcctgctgctgacccgcgacggcggcaaggagaagaacgacaccgagaccttccgccccggcggcggcgacatgcgcgacaactggcgctccgagctgtacaagtacaaggtggtggagatcaagcccctgggcatcgcccccgacaaggccaagcgccgcgtggtggagcgcgagaagcgcgccgtgggcatcggcgccgtgttcctgggcttcctgggcgccgccggcagcaccatgggcgccgccagcatgaccctgaccgtgcaggcccgccagctgctgagcggcatcgtgcagcagcagagcaacctgctgcgcgccatcgaggcccagcagcacatgctgcagctgaccgtgtggggcatcaagcagctgcagacccgcgtgctggccatcgagcgctacctgaaggaccagcagctgctgggcatctggggctgcagcggcaagctgatctgcaccaccgccgtgccctggaacgccagctggagcaacaagagctacgaggagatctggggcaacatgacctggatgcagtgggaccgcgagatcaacaactacaccaacaccatctacagcctgctggaggagagccagaaccagcaggagaagaacgagaaggacctgctggccctggacagctgggagagcctgtggagctggttcaacatcaccaactggctgtggtacatccgcatcttcatcatcatcgtgggcggcctgatcggcctgcgcatcatcttcgccgtgctgagcatcgtgaaccgcgtgcgccagggctacagccccctgagcttccagaccctgacccccagcccccgcgagcccgaccgcctgggccgcatcgaggaggagggcggcgagcaggaccgcgcccgcagcgtgcgcctggtgaacggcttcctggccctggcctgggaggacctgcgcagcctgtgcctgttcagctaccaccgcctgcgcgacctgatcctgatcgccgcccgcgccgccgccctgctgggccgcagcagcctgtggggcctgcagaagggctgggaggccctgaagtacctgggcagcctggtgcagtactggggcctggagctgaagaagagcgccatcagcctgttcgacgccatcgccatcaccgtggccgagggcaccgaccgcatcatcaacatcgtgcagcgcatcagccgcgccttctacaacatcccccgccgcatccgccagggcttcgaggccaccctgcagtaaggtacctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggccagatatcgatatgctggccaccgtgcatgtgacctcgcacccccgcaagacatggcccgagttcgagcacaacgtcatgacccgatgcaatgtgcacctggggtcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcttgtatgaggggcagaatgactaaaatctgtgtttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgacttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggcgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagyccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggtcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcgggccggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggctggcataacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcagaagctcggggtcgaagtagctgatgcaggtgtccagatcgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgtgcggccttgcgcagggaggtgtgggtgagggcgaaggtgtcgcgcaccatgaccttgaggaactggtgcttgaagtcgaggtcgtcgcagccgccctgctcccagagctggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttaacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacttcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgccggtcagaagcggcggcgaggacgcgcgccgggcggcaggggcggctcgggacccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcagcgatggtggcgcgcacctcgcgctcgaaggccccggggggctcctcttcttccatctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcggggatttcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctgtatctgggtgagggtggtctggaagtcgtcgaagtcgacgaagcggtggtaggctccggtgttgatggtataggagcagttggccatgacggaccagttgacggtctggtggccgggtcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcgaccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccacctcaaccgcccctaccgccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggctatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgctcgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccgccaccaccgtgtggaagaaagagggcggggaccggcggccgtcctcggcgctgtccggtcgcgcgggtgctgccgcggcggtgcctgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcacccgtagacgccagcgacacgacaggcagcggggtctggtgtgggacgatgaggattccgccgacgacagcagcgtgttggacttgggtgggagtggtggtggtaacccgttcgctcacttgcgcccccgtatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaatggggtcgcggtggatgagaattatgatggtagtcaggacgagctgacttacgagtgggtggagtttgagctgcccgagggcaacttctcggtgaccatgaccatcgatctgatgaacaacgccatcatcgacaactacttggcggtggggcgtcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctatgagaaaagcaaggaggaggccgccgcagcggcgaccgcagccgtggccaccgcctctaccgaggtgcggggcgataattttgctagcgccgcggcagtggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgcctccaccgtggacgccgtcatcgacagcgtggtggccgatgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggtgaaggaggaaagaaagccccgcaaactgaagcgggtcaaaaaggacaaaaaggaggaggaagatgtggacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcttccaccactcgccgaagacgcaagtacggcgcggccagcctgctgatgcccaactacgcgctgcatccttccatcatccccacgccgggctaccgcggcacgcgcttctaccgcggctacaccagcagccgccgcaagaccaccacccgccgccgccgtcgtcgcacccgccgcagcagcaccgcgacttccgccgccgccctggtgcggagagtgtaccgcagcgggcgcgagcctctgaccctgccgcgcgcgcgctaccacccgagcatcgccatttaactctgccgtcgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcgggggcccagcttcaaaccctactccggcaccgcctacaacagcctggctcccaagggagcgcccaacacttgccagtggacatataaagctggtgatactgatacagaaaaaacctatacatatggaaatgcacctgtgcaaggcattagcattacaaaggatggtattcaacttggaactgacagcgatggtcaggcaatctatgcagacgaaacttatcaaccagagcctcaagtgggtgatgctgaatggcatgacatcactggtactgatgaaaaatatggaggcagagctcttaagcctgacaccaaaatgaagccttgctatggttcttttgccaagcctaccaataaagaaggaggccaggcaaatgtgaaaaccgaaacaggcggtaccaaagaatatgacattgacatggcattcttcgataatcgaagtgcagctgccgccggcctagccccagaaattgttttgtatactgagaatgtggatctggaaactccagatacccatattgtatacaaggcaggtacagatgacagtagctcttctatcaatttgggtcagcagtccatgcccaacagacccaactacattggcttcagagacaactttatcggtctgatgtactacaacagcactggcaatatgggtgtactggctggacaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaatcacggtgtggaggatgaacttcctaactattgcttccccctggatgctgtgggtagaactgatacttaccagggaattaaggccaatggtgataatcaaaccacctggaccaaagatgatactgttaatgatgctaatgaattgggcaagggcaatcctttcgccatggagatcaacatccaggccaacctgtggcggaacttcctctacgcgaacgtggcgctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgataccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagcctcttgcttcttgcaagatgacggcctgcgcgggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaatccggtgtgtgtatgtgaatgctttattcatcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccagcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcggaatgccgcggtgctcctcgttcacatacaggtggcagatacggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgttgtcatcttagtcgccgccgccgaagtcagggggtcgttctcgtccagggtctcaaacactcgcttgccgtccttctcggtgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgccgacgagaaccagcagcagcagaatgaaagcttaaccgccccgccgcccagccccacctccgacgccgcagccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcagacacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggaggaggagaaagcaagcagcacggataccatctccgctccgggtcggggtcgcggcggccgggcccacagtagatgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagcagcagaaaaccagcggcagcagctagaaaatccacagcggcggcaggtggactgaggatcgcggcgaacgagccggcgcagacccgggagctgaggaaccggatctttcccaccctctatgccatcttccagcagagtcgggggcaagagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggtctcgactcccacctgcttcggatcttcagccagcgtccgatcctggccgagcgcgagcaaggacagacccttctgaccctgtactgcatctgcaaccaccccggcctgcatgaaagtctttgttgtctgctgtgtactgagtataataaaagctgagatcagcgactactccggacttccgtgtgttcctgctatcaaccagtccctgttcttcaccgggaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgaccgcggacatgtacagagctcgagaagtactaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcaccccgaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaatatcatattgatgatgatttaaataaaaaataatcatttgatttgaaataaagatacaatcatattgatgatttgagttttaaaaaataaagaatcacttacttgaaatctgataccaggtctctgtccatgttttctgccaacaccacctcactcccctcttcccagctctggtactgcagaccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgactggctgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctctttataccaaagatggaaaattatccttacaagtttctccaccgttaaacatattaaaatcaaccattctgaacacattagctgtagcttatggatcaggtttaggactgagtggtggcactgctcttgcagtacagttggcctctccactcacttttgatgaaaaaggaaatattaaaattaacctagccagtggtccattaacagttgatgcaagtcgacttagtatcaactgcaaaagaggggtcactgtcactacctcaggagatgcaattgaaagcaacataagctggcctaaaggtataagatttgaaggtaatggcatagctgcaaacattggcagaggattggaatttggaaccactagtacagagactgatgtcacagatgcatacccaattcaagttaaattgggtactggccttacctttgacagtacaggcgccattgttgcttggaacaaagaggatgataaacttacattatggaccacagccgacccctcgccaaattgcaaaatatactctgaaaaagatgccaaactcacactttgcttgacaaagtgtggaagtcaaattctgggtactgtgactgtattggcagtgaataatggaagtctcaacccaatcacaaacacagtaagcactgcactcgtctccctcaagtttgatgcaagtggagttttgctaagcagctccacattagacaaagaatattggaacttcagaaagggagatgttacacctgctgagccctatactaatgctataggttttatgcctaacataaaggcctatcctaaaaacacatctgcagcttcaaaaagccatattgtcagtcaagtttatctcaatggggatgaggccaaaccactgatgctgattattacttttaatgaaactgaggatgcaacttgcacctacagtatcacttttcaatggaaatgggatagtactaagtacacaggtgaaacacttgctaccagctccttcaccttctcctacatcgcccaagaatgaacactgtatcccaccctgcatgccaacccttcccaccccactctgtctatggaaaaaactctgaagcacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtcccggcgcttggaacgctcggtgttgaaattgtaaaacagccactctctcagaccgtgcagcagatctagggcctcaggagtgatgaagatcccatcatgcctgatagctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaaggtcgcggagatggcacctctcgcccccgctgtgttggtg

SEQ ID NO: 8 - DNA, 32767 bp, Artificial Sequence
  Artificially Synthesized
catcatcaataatatacctcaaacttttggtgcgcgttaatatgcaaatgagctgtttgaatttggggagggaggaaggtgattggccgagagacgggcgaccgttaggggcggggcgggtgacgttttgatgacgtggccgtgaggcggagccggtttgcaagttctcgtgggaaaagtgacgtcaaacgaggtgtggtttgaacacggaaatactcaattttcccgcgctctctgacaggaaatgaggtgtttctgggcggatgcaagtgaaaacgggccattttcgcgcgaaaactgaatgaggaagtgaaaatctgagtaatttcgcgtttatggcagggaggagtatttgccgagggccgagtagactttgaccgattacgtgggggtttcgattaccgtatttttcacctaaatttccgcgtacggtgtcaaagtccggtgtttttacgtacgatatcatttccccgaaagtgccacctgaccgtaactataacggtcctaaggtagcgaaagctcagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagtatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcactagaagctttattgcggtagtttatcacagttaaattgctaacgcagtcagtgcttctgacacaacagtctcgaacttaaggctagagttcgacgccaccatgcgcgtgcgcggcatcccccgcaactggccccagtggtggatctggggcatcctgggcttctggatgatcatcatctgccgcgtggtgggcaacctggacctgtgggtgaccgtgtactacggcgtgcccgtgtggaaggaggccaagaccaccctgttctgcgcctccgacgccaaggcctacgacaaggaggtgcacaacgtgtgggccacccacgcctgcgtgcccaccgaccccaacccccaggagatcgtgctggagaacgtgaccgagaacttcaacatgtggaagaacgacatggtggaccagatgcacgaggacatcatctccctgtgggaccagtccctgaagccctgcgtgaagctgacccccctgtgcgtgaccctgaactgcaagaacgtgaacatctccgccaacgccaacgccaccgccaccctgaactcctccatgaacggcgagatcaagaactgctccttcaacaccaccaccgagctgcgcgacaagaagcagaaggtgtacgccctgttctacaagcccgacgtggtgcccctgaacggcggcgagcacaacgagaccggcgagtacatcctgatcaactgcaactcctccaccatcacccaggcctgccccaaggtgtccttcgaccccatccccatccactactgcgcccccgccggctacgccatcctgaagtgcaacaacaagaccttcaacggcaccggcccctgcaacaacgtgtccaccgtgcagtgcacccacggcatcaagcccgtggtgtccacccagctgctgctgaacggctccctggccgaggaggagatcatcgtgcgctccgagaacctgaccaacaacatcaagaccatcatcgtgcacctgaacaagtccgtggagatcaagtgcacccgccccaacaacaacacccgcaagtccgtgcgcatcggccccggccagaccttctacgccaccggcgagatcatcggcgacatccgcgaggcccactgcaacatctcccgcgagacctggaactccaccctgatccaggtgaaggagaagctgcgcgagcactacaacaagaccatcaagttcgagccctcctccggcggcgacctggaggtgaccacccactccttcaactgccgcggcgagttcttctactgcgacaccaccaagctgttcaacgagaccaagctgttcaacgagtccgagtacgtggacaacaagaccatcatcctgccctgccgcatcaagcagatcatcaacatgtggcaggaggtgggccgcgccatgtacgccccccccatcgagggcaacatcacctgcaagtccaacatcaccggcctgctgctgacctgggacggcggcgagaactccaccgagggcgtgttccgccccggcggcggcaacatgaaggacaactggcgctccgagctgtacaagtacaaggtggtggagatcaagcccctgggcgtggcccccaccaagagcaagcgcaaggtggtgggccgcgagaagcgcgccgtgggcctgggcgccgtgctgctgggcttcctgggcgccgccggcagcaccatgggcgccgccagcatcaccctgaccgtgcaggcccgccagctgctgagcggcatcgtgcagcagcagagcaacctgctgcgcgccatcgaggcccagcagcacctgctgcagctgaccgtgtggggcatcaagcagctgcagacccgcgtgctggccatcgagcgctacctgaaggaccagcagctgctgggcctgtggggctgcagcggcaagctgatctgcgccaccgccgtgccctggaacagcagctggagcaacaagagcctgggcgacatctgggacaacatgacctggatgcagtgggaccgcgagatcagcaactacaccaacaccatcttccgcctgctggaggacagccagaaccagcaggagaagaacgagaaggacctgctggccctggacagctggaagaacctgtggaactggttcgacatcaccaactggctgtggtacatcaagatcttcatcatgatcgtgggcggcctgatcggcctgcgcatcatcttcggcgtgctggccatcgtgaagcgcgtgcgccagggctacagccccctgagcttccagaccctgatccccaacccccgcggccccgaccgcctgggccgcatcgaggaggagggcggcgagcaggacaaggaccgcagcatccgcctggtgagcggcttcctggccctggcctgggacgacctgcgcagcctgtgcctgttcagctaccaccagctgcgcgacttcatcctgaccgccgcccgcgccgccgagctgctgggccgcagcagcctgcgcggcctgcagcgcggctgggaggtgctgaagtacctgggcaacctggtgcagtactggggcctggagctgaagcgcagcgccatcaacctgttcgacaccatcgccatcgccgtggccgagggcaccgaccgcatcatcgaggtgatccagcgcatctgccgcgccatccgctacatccccacccgcatccgccagggcttcgaggccgccctgctgtaaggtacctctagagtcgacccgggcggccaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagcagatctgcagatctgaattcatctatgtcgggtgcggagaaagaggtaatgaaatggcattatgggtattatgggtctgcattaatgaatcggccagatatcgatatgctggccaccgtgcatgtgacctcgcacccccgcaagacatggcccgagttcgagcacaacgtcatgacccgatgcaatgtgcacctggggtcccgccgaggcatgttcatgccctaccagtgcaacatgcaatttgtgaaggtgctgctggagcccgatgccatgtccagagtgagcctgacgggggtgtttgacatgaatgtggagctgtggaaaattctgagatatgatgaatccaagaccaggtgccgggcctgcgaatgcggaggcaagcacgccaggcttcagcccgtgtgtgtggaggtgacggaggacctgcgacccgatcatttggtgttgtcctgcaacgggacggagttcggctccagcggggaagaatctgactagagtgagtagtgtttgggggaggtggagggcttgtatgaggggcagaatgactaaaatctgtgtttttctgtgtgttgcagcagcatgagcggaagcgcctcctttgagggaggggtattcagcccttatctgacggggcgtctcccctcctgggcgggagtgcgtcagaatgtgatgggatccacggtggacggccggcccgtgcagcccgcgaactcttcaaccctgacctacgcgaccctgagctcctcgtccgtggacgcagctgccgccgcagctgctgcttccgccgccagcgccgtgcgcggaatggccctgggcgccggctactacagctctctggtggccaactcgacttccaccaataatcccgccagcctgaacgaggagaagctgctgctgctgatggcccagctcgaggccctgacccagcgcctgggcgagctgacccagcaggtggctcagctgcaggcggagacgcgggccgcggttgccacggtgaaaaccaaataaaaaatgaatcaataaataaacggagacggttgttgattttaacacagagtcttgaatctttatttgatttttcgcgcgcggtaggccctggaccaccggtctcgatcattgagcacccggtggattttttccaggacccggtagaggtgggcttggatgttgaggtacatgggcatgagcccgtcccgggggtggaggtagctccattgcagggcctcgtgctcgggggtggtgttgtaaatcacccagtcatagcaggggcgcagggcgtggtgctgcacgatgtccttgaggaggagactgatggccacgggcagccccttggtgtaggtgttgacgaacctgttgagctgggagggatgcatgcggggggagatgagatgcatcttggcctggatcttgagattggcgatgttcccgcccagatcccgccgggggttcatgttgtgcaggaccaccagcacggtgtatccggcgcacttggggaatttgtcatgcaacttggaagggaaggcgtgaaagaatttggagacgcccttgtgaccgcccaggttttccatgcactcatccatgatgatggcgatgggcccgtgggcggcggcctgggcaaagacgtttcgggggtcggacacatcgtagttgtggtcctgggtgagctcgtcataggccattttaatgaatttggggcggagggtgcccgactgggggacgaaggtgccctcgatcccgggggcgtagttgccctcgcagatctgcatctcccaggccttgagctcggagggggggatcatgtccacctgcggggcgatgaaaaaaacggtttccggggcgggggagatgagctgggccgaaagcaggttccggagcagctgggacttgccgcagccggtggggccgtagatgaccccgatgaccggctgcaggtggtagttgagggagagacagctgccgtcctcgcggaggaggggggccacctcgttcatcatctcgcgcacatgcatgttctcgcgcacgagttccgccaggaggcgctcgccccccagcgagaggagctcttgcagcgaggcgaagtttttcagcggcttgagyccgtcggccatgggcattttggagagggtctgttgcaagagttccagacggtcccagagctcggtgatgtgctctagggcatctcgatccagcagacctcctcgtttcgcgggttggggcgactgcgggagtagggcaccaggcgatgggcgtccagcgaggccagggtccggtccttccagggtcgcagggtccgcgtcagcgtggtctccgtcacggtgaaggggtgcgcgccgggctgggcgcttgcgagggtgcgcttcaggctcatccggctggtcgagaaccgctcccggtcggcgccctgcgcgtcggccaggtagcaattgagcatgagttcgtagttgagcgcctcggccgcgtggcccttggcgcggagcttacctttggaagtgtgtccgcagacgggacagaggagggacttgagggcgtagagcttgggggcgaggaagacggactcgggggcgtaggcgtccgcgccgcagctggcgcagacggtctcgcactccacgagccaggtgaggtcgggccggttggggtcaaaaacgaggtttcctccgtgctttttgatgcgtttcttacctctggtctccatgagctcgtgtccccgctgggtgacaaagaggctgtccgtgtccccgtagaccgactttatgggccggtcctcgagcggggtgccgcggtcctcgtcgtagaggaaccccgcccactccgagacgaaggcccgggtccaggccagcacgaaggaggccacgtgggaggggtagcggtcgttgtccaccagcgggtccaccttctccagggtatgcaagcacatgtccccctcgtccacatccaggaaggtgattggcttgtaagtgtaggccacgtgaccgggggtcccggccgggggggtataaaagggggcgggcccctgctcgtcctcactgtcttccggatcgctgtccaggagcgccagctgttggggtaggtattccctctcgaaggctggcataacctcggcactcaggttgtcagtttctagaaacgaggaggatttgatattgacggtgccgttggagacgcctttcatgagcccctcgtccatctggtcagaaaagacgatctttttgttgtcgagcttggtggcgaaggagccgtagagggcgttggagaggagcttggcgatggagcgcatggtctggttcttttccttgtcggcgcgctccttggcggcgatgttgagctgcacgtactcgcgcgccacgcacttccattcggggaagacggtggtgagctcgtcgggcacgattctgacccgccagccgcggttgtgcagggtgatgaggtccacgctggtggccacctcgccgcgcaggggctcgttggtccagcagaggcgcccgcccttgcgcgagcagaaggggggcagcgggtccagcatgagctcgtcgggggggtcggcgtccacggtgaagatgccgggcagaagctcggggtcgaagtagctgatgcaggtgtccagatcgtccagcgccgcttgccagtcgcgcacggccagcgcgcgctcgtaggggctgaggggcgtgccccagggcatggggtgcgtgagcgcggaggcgtacatgccgcagatgtcgtagacgtagaggggctcctcgaggacgccgatgtaggtggggtagcagcgccccccgcggatgctggcgcgcacgtagtcgtacagctcgtgcgagggcgcgaggagccccgtgccgaggttggagcgttgcggcttttcggcgcggtagacgatctggcggaagatggcgtgggagttggaggagatggtgggcctctggaagatgttgaagtgggcgtggggcaggccgaccgagtccctgatgaagtgggcgtaggagtcctgcagcttggcgacgagctcggcggtgacgaggacgtccagggcgcagtagtcgagggtctcttggatgatgtcgtacttgagctggcccttctgcttccacagctcgcggttgagaaggaactcttcgcggtccttccagtactcttcgagggggaacccgtcctgatcggcacggtaagagcccaccatgtagaactggttgacggccttgtaggcgcagcagcccttctccacggggagggcgtaagcttgtgcggccttgcgcagggaggtgtgggtgagggcgaaggtgtcgcgcaccatgaccttgaggaactggtgcttgaagtcgaggtcgtcgcagccgccctgctcccagagctggaagtccgtgcgcttcttgtaggcggggttgggcaaagcgaaagtaacatcgttgaagaggatcttgcccgcgcggggcatgaagttgcgagtgatgcggaaaggctggggcacctcggcccggttgttgatgacctgggcggcgaggacgatctcgtcgaagccgttgatgttgtgcccgacgatgtagagttccacgaatcgcgggcggcccttaacgtggggcagcttcttgagctcgtcgtaggtgagctcggcggggtcgctgagcccgtgctgctcgagggcccagtcggcgacgtgggggttggcgctgaggaaggaagtccagagatccacggccagggcggtctgcaagcggtcccggtactgacggaactgctggcccacggccattttttcgggggtgacgcagtagaaggtgcgggggtcgccgtgccagcggtcccacttgagctggagggcgaggtcgtgggcgagctcgacgagcggcgggtccccggagagtttcatgaccagcatgaaggggacgagctgcttgccgaaggaccccatccaggtgtaggtttccacatcgtaggtgaggaagagcctttcggtgcgaggatgcgagccgatggggaagaactggatctcctgccaccagttggaggaatggctgttgatgtgatggaagtagaaatgccgacggcgcgccgagcactcgtgcttgtgtttatacaagcgtccgcagtgctcgcaacgctgcacgggatgcacgtgctgcacgagctgtacctgggttcctttgacgaggaatttcagtgggcagtggagcgctggcggctgcatctggtgctgtactacgtcctggccatcggcgtggccatcgtctgcctcgatggtggtcatgctgacgagcccgcgcgggaggcaggtccagacttcggctcggacgggtcggagagcgaggacgagggcgcgcaggccggagctgtccagggtcctgagacgctgcggagtcaggtcagtgggcagcggcggcgcgcggttgacttgcaggagcttttccagggcgcgcgggaggtccagatggtacttgatctccacggcgccgttggtggcgacgtccacggcttgcagggtcccgtgcccctggggcgccaccaccgtgccccgtttcttcttgggcgctgcttccatgccggtcagaagcggcggcgaggacgcgcgccgggcggcaggggcggctcgggacccggaggcaggggcggcaggggcacgtcggcgccgcgcgcgggcaggttctggtactgcgcccggagaagactggcgtgagcgacgacgcgacggttgacgtcctggatctgacgcctctgggtgaaggccacgggacccgtgagtttgaacctgaaagagagttcgacagaatcaatctcggtatcgttgacggcggcctgccgcaggatctcttgcacgtcgcccgagttgtcctggtaggcgatctcggtcatgaactgctcgatctcctcctcctgaaggtctccgcggccggcgcgctcgacggtggccgcgaggtcgttggagatgcggcccatgagctgcgagaaggcgttcatgccggcctcgttccagacgcggctgtagaccacggctccgtcggggtcgcgcgcgcgcatgaccacctgggcgaggttgagctcgacgtggcgcgtgaagaccgcgtagttgcagaggcgctggtagaggtagttgagcgtggtggcgatgtgctcggtgacgaagaagtacatgatccagcggcggagcggcatctcgctgacgtcgcccagggcttccaagcgctccatggcctcgtagaagtccacggcgaagttgaaaaactgggagttgcgcgccgagacggtcaactcctcctccagaagacggatgagctcagcgatggtggcgcgcacctcgcgctcgaaggccccggggggctcctcttcttccatctcttcctcctccactaacatctcttctacttcctcctcaggaggcggcggcgggggaggggccctgcgtcgccggcggcgcacgggcagacggtcgatgaagcgctcgatggtctccccgcgccggcgacgcatggtctcggtgacggcgcgcccgtcctcgcggggccgcagcgtgaagacgccgccgcgcatctccaggtggccgccgggggggtctccgttgggcagggagagggcgctgacgatgcatcttatcaattggcccgtagggactccgcgcaaggacctgagcgtctcgagatccacgggatccgaaaaccgctgaacgaaggcttcgagccagtcgcagtcgcaaggtaggctgagcccggtttcttgttcttcggggatttcgggaggcgggcgggcgatgctgctggtgatgaagttgaagtaggcggtcctgagacggcggatggtggcgaggagcaccaggtccttgggcccggcttgctggatgcgcagacggtcggccatgccccaggcgtggtcctgacacctggcgaggtccttgtagtagtcctgcatgagccgctccacgggcacctcctcctcgcccgcgcggccgtgcatgcgcgtgagcccgaacccgcgctggggctggacgagcgccaggtcggcgacgacgcgctcggcgaggatggcctgctgtatctgggtgagggtggtctggaagtcgtcgaagtcgacgaagcggtggtaggctccggtgttgatggtataggagcagttggccatgacggaccagttgacggtctggtggccgggtcgcacgagctcgtggtacttgaggcgcgagtaggcgcgcgtgtcgaagatgtagtcgttgcaggtgcgcacgaggtactggtatccgacgaggaagtgcggcggcggctggcggtagagcggccatcgctcggtggcgggggcgccgggcgcgaggtcctcgagcatgaggcggtggtagccgtagatgtacctggacatccaggtgatgccggcggcggtggtggaggcgcgcgggaactcgcggacgcggttccagatgttgcgcagcggcaggaagtagttcatggtggccgcggtctggcccgtgaggcgcgcgcagtcgtggatgctctagacatacgggcaaaaacgaaagcggtcagcggctcgactccgtggcctggaggctaagcgaacgggttgggctgcgcgtgtaccccggttcgaatctcgaatcaggctggagccgcagctaacgtggtactggcactcccgtctcgacccaagcctgctaacgaaacctccaggatacggaggcgggtcgttttttggccttggtcgctggtcatgaaaaactagtaagcgcggaaagcgaccgcccgcgatggctcgctgccgtagtctggagaaagaatcgccagggttgcgttgcggtgtgccccggttcgagcctcagcgctcggcgccggccggattccgcggctaacgtgggcgtggctgccccgtcgtttccaagaccccttagccagccgacttctccagttacggagcgagcccctctttttcttgtgtttttgccagatgcatcccgtactgcggcagatgcgcccccaccctccacctcaaccgcccctaccgccgcagcagcagcaacagccggcgcttctgcccccgccccagcagcagccagccactaccgcggcggccgccgtgagcggagccggcgttcagtatgacctggccttggaagagggcgaggggctggcgcggctgggggcgtcgtcgccggagcggcacccgcgcgtgcagatgaaaagggacgctcgcgaggcctacgtgcccaagcagaacctgttcagagacaggagcggcgaggagcccgaggagatgcgcgcctcccgcttccacgcggggcgggagctgcggcgcggcctggaccgaaagcgggtgctgagggacgaggatttcgaggcggacgagctgacggggatcagccccgcgcgcgcgcacgtggccgcggccaacctggtcacggcgtacgagcagaccgtgaaggaggagagcaacttccaaaaatccttcaacaaccacgtgcgcacgctgatcgcgcgcgaggaggtgaccctgggcctgatgcacctgtgggacctgctggaggccatcgtgcagaaccccacgagcaagccgctgacggcgcagctgtttctggtggtgcagcacagtcgggacaacgagacgttcagggaggcgctgctgaatatcaccgagcccgagggccgctggctcctggacctggtgaacattctgcagagcatcgtggtgcaggagcgcgggctgccgctgtccgagaagctggcggctatcaacttctcggtgctgagcctgggcaagtactacgctaggaagatctacaagaccccgtacgtgcccatagacaaggaggtgaagatcgacgggttttacatgcgcatgaccctgaaagtgctgaccctgagcgacgatctgggggtgtaccgcaacgacaggatgcaccgcgcggtgagcgccagccgccggcgcgagctgagcgaccaggagctgatgcacagcctgcagcgggccctgaccggggccgggaccgagggggagagctactttgacatgggcgcggacctgcgctggcagcccagccgccgggccttggaagctgccggcggttccccctacgtggaggaggtggacgatgaggaggaggagggcgagtacctggaagactgatggcgcgaccgtatttttgctagatgcagcaacagccaccgcctcctgatcccgcgatgcgggcggcgctgcagagccagccgtccggcattaactcctcggacgattggacccaggccatgcaacgcatcatggcgctgacgacccgcaatcccgaagcctttagacagcagcctcaggccaaccggctctcggccatcctggaggccgtggtgccctcgcgctcgaaccccacgcacgagaaggtgctggccatcgtgaacgcgctggtggagaacaaggccatccgcggcgacgaggccgggctggtgtacaacgcgctgctggagcgcgtggcccgctacaacagcaccaacgtgcagacgaacctggaccgcatggtgaccgacgtgcgcgaggcggtgtcgcagcgcgagcggttccaccgcgagtcgaacctgggctccatggtggcgctgaacgccttcctgagcacgcagcccgccaacgtgccccggggccaggaggactacaccaacttcatcagcgcgctgcggctgatggtggccgaggtgccccagagcgaggtgtaccagtcggggccggactacttcttccagaccagtcgccagggcttgcagaccgtgaacctgagccaggctttcaagaacttgcagggactgtggggcgtgcaggccccggtcggggaccgcgcgacggtgtcgagcctgctgacgccgaactcgcgcctgctgctgctgctggtggcgcccttcacggacagcggcagcgtgagccgcgactcgtacctgggctacctgcttaacctgtaccgcgaggccatcgggcaggcgcacgtggacgagcagacctaccaggagatcacccacgtgagccgcgcgctgggccaggaggacccgggcaacctggaggccaccctgaacttcctgctgaccaaccggtcgcagaagatcccgccccagtacgcgctgagcaccgaggaggagcgcatcctgcgctacgtgcagcagagcgtggggctgttcctgatgcaggagggggccacgcccagcgccgcgctcgacatgaccgcgcgcaacatggagcccagcatgtacgctcgcaaccgcccgttcatcaataagctgatggactacttgcatcgggcggccgccatgaactcggactactttaccaacgccatcttgaacccgcactggctcccgccgcccgggttctacacgggcgagtacgacatgcccgaccccaacgacgggttcctgtgggacgacgtggacagcagcgtgttctcgccgcgccccgccaccaccgtgtggaagaaagagggcggggaccggcggccgtcctcggcgctgtccggtcgcgcgggtgctgccgcggcggtgcctgaggccgccagccccttcccgagcctgcccttttcgctgaacagcgtgcgcagcagcgagctgggtcggctgacgcggccgcgcctgctgggcgaggaggagtacctgaacgactccttgttgaggcccgagcgcgagaagaacttccccaataacgggatagagagcctggtggacaagatgagccgctggaagacgtacgcgcacgagcacagggacgagccccgagctagcagcagcgcaggcacccgtagacgccagcgacacgacaggcagcggggtctggtgtgggacgatgaggattccgccgacgacagcagcgtgttggacttgggtgggagtggtggtggtaacccgttcgctcacttgcgcccccgtatcgggcgcctgatgtaagaatctgaaaaaataaaaaacggtactcaccaaggccatggcgaccagcgtgcgttcttctctgttgtttgtagtagtatgatgaggcgcgtgtacccggagggtcctcctccctcgtacgagagcgtgatgcagcaggcggtggcggcggcgatgcagcccccgctggaggcgccttacgtgcccccgcggtacctggcgcctacggaggggcggaacagcattcgttactcggagctggcacccttgtacgataccacccggttgtacctggtggacaacaagtcggcggacatcgcctcgctgaactaccagaacgaccacagcaacttcctgaccaccgtggtgcagaacaacgatttcacccccacggaggccagcacccagaccatcaactttgacgagcgctcgcggtggggcggccagctgaaaaccatcatgcacaccaacatgcccaacgtgaacgagttcatgtacagcaacaagttcaaggcgcgggtgatggtctcgcgcaagacccccaatggggtcgcggtggatgagaattatgatggtagtcaggacgagctgacttacgagtgggtggagtttgagctgcccgagggcaacttctcggtgaccatgaccatcgatctgatgaacaacgccatcatcgacaactacttggcggtggggcgtcagaacggggtgctggagagcgacatcggcgtgaagttcgacacgcgcaacttccggctgggctgggaccccgtgaccgagctggtgatgccgggcgtgtacaccaacgaggccttccaccccgacatcgtcctgctgcccggctgcggcgtggacttcaccgagagccgcctcagcaacctgctgggcatccgcaagcggcagcccttccaggagggcttccagatcctgtacgaggacctggaggggggcaacatccccgcgctcttggatgtcgaagcctatgagaaaagcaaggaggaggccgccgcagcggcgaccgcagccgtggccaccgcctctaccgaggtgcggggcgataattttgctagcgccgcggcagtggccgaggcggctgaaaccgaaagtaagatagtcatccagccggtggagaaggacagcaaggacaggagctacaacgtgctcgcggacaagaaaaacaccgcctaccgcagctggtacctggcctacaactacggcgaccccgagaagggcgtgcgctcctggacgctgctcaccacctcggacgtcacctgcggcgtggagcaagtctactggtcgctgcccgacatgatgcaagacccggtcaccttccgctccacgcgtcaagttagcaactacccggtggtgggcgccgagctcctgcccgtctactccaagagcttcttcaacgagcaggccgtctactcgcagcagctgcgcgccttcacctcgctcacgcacgtcttcaaccgcttccccgagaaccagatcctcgtccgcccgcccgcgcccaccattaccaccgtcagtgaaaacgttcctgctctcacagatcacgggaccctgccgctgcgcagcagtatccggggagtccagcgcgtgaccgtcactgacgccagacgccgcacctgcccctacgtctacaaggccctgggcgtagtcgcgccgcgcgtcctctcgagccgcaccttctaaaaaatgtccattctcatctcgcccagtaataacaccggttggggcctgcgcgcgcccagcaagatgtacggaggcgctcgccaacgctccacgcaacaccccgtgcgcgtgcgcgggcacttccgcgctccctggggcgccctcaagggccgcgtgcgctcgcgcaccaccgtcgacgacgtgatcgaccaggtggtggccgacgcgcgcaactacacgcccgccgccgcgcccgcctccaccgtggacgccgtcatcgacagcgtggtggccgatgcgcgccggtacgcccgcgccaagagccggcggcggcgcatcgcccggcggcaccggagcacccccgccatgcgcgcggcgcgagccttgctgcgcagggccaggcgcacgggacgcagggccatgctcagggcggccagacgcgcggcctccggcagcagcagcgccggcaggacccgcagacgcgcggccacggcggcggcggcggccatcgccagcatgtcccgcccgcggcgcggcaacgtgtactgggtgcgcgacgccgccaccggtgtgcgcgtgcccgtgcgcacccgcccccctcgcacttgaagatgctgacttcgcgatgttgatgtgtcccagcggcgaggaggatgtccaagcgcaaatacaaggaagagatgctccaggtcatcgcgcctgagatctacggccccgcggtgaaggaggaaagaaagccccgcaaactgaagcgggtcaaaaaggacaaaaaggaggaggaagatgtggacggactggtggagtttgtgcgcgagttcgccccccggcggcgcgtgcagtggcgcgggcggaaagtgaaaccggtgctgcggcccggcaccacggtggtcttcacgcccggcgagcgttccggctccgcctccaagcgctcctacgacgaggtgtacggggacgaggacatcctcgagcaggcggtcgagcgtctgggcgagtttgcttacggcaagcgcagccgccccgcgcccttgaaagaggaggcggtgtccatcccgctggaccacggcaaccccacgccgagcctgaagccggtgaccctgcagcaggtgctgccgagcgcggcgccgcgccggggcttcaagcgcgagggcggcgaggatctgtacccgaccatgcagctgatggtgcccaagcgccagaagctggaggacgtgctggagcacatgaaggtggaccccgaggtgcagcccgaggtcaaggtgcggcccatcaagcaggtggccccgggcctgggcgtgcagaccgtggacatcaagatccccacggagcccatggaaacgcagaccgagcccgtgaagcccagcaccagcaccatggaggtgcagacggatccctggatgccggcgccggcttccaccactcgccgaagacgcaagtacggcgcggccagcctgctgatgcccaactacgcgctgcatccttccatcatccccacgccgggctaccgcggcacgcgcttctaccgcggctacaccagcagccgccgcaagaccaccacccgccgccgccgtcgtcgcacccgccgcagcagcaccgcgacttccgccgccgccctggtgcggagagtgtaccgcagcgggcgcgagcctctgaccctgccgcgcgcgcgctaccacccgagcatcgccatttaactctgccgtcgcctcctacttgcagatatggccctcacatgccgcctccgcgtccccattacgggctaccgaggaagaaagccgcgccgtagaaggctgacggggaacgggctgcgtcgccatcaccaccggcggcggcgcgccatcagcaagcggttggggggaggcttcctgcccgcgctgatccccatcatcgccgcggcgatcggggcgatccccggcatagcttccgtggcggtgcaggcctctcagcgccactgagacacagcttggaaaatttgtaataaaaaaatggactgacgctcctggtcctgtgatgtgtgtttttagatggaagacatcaatttttcgtccctggcaccgcgacacggcacgcggccgtttatgggcacctggagcgacatcggcaacagccaactgaacgggggcgccttcaattggagcagtctctggagcgggcttaagaatttcgggtccacgctcaaaacctatggcaacaaggcgtggaacagcagcacagggcaggcgctgagggaaaagctgaaagagcagaacttccagcagaaggtggtcgatggcctggcctcgggcatcaacggggtggtggacctggccaaccaggccgtgcagaaacagatcaacagccgcctggacgcggtcccgcccgcggggtccgtggagatgccccaggtggaggaggagctgcctcccctggacaagcgcggcgacaagcgaccgcgtcccgacgcggaggagacgctgctgacgcacacggacgagccgcccccgtacgaggaggcggtgaaactgggtctgcccaccacgcggcccgtggcgcctctggccaccggggtgctgaaacccagcagcagcagccagcccgcgaccctggacttgcctccgcctgcttcccgcccctccacagtggctaagcccctgccgccggtggccgtcgcgtcgcgcgccccccgaggccgcccccaggcgaactggcagagcactctgaacagcatcgtgggtctgggagtgcagagtgtgaagcgccgccgctgctattaaaagacactgtagcgcttaacttgcttgtctgtgtgtatatgtatgtccgccgaccagaaggaggaagaggcgcgtcgccgagttgcaagatggccaccccatcgatgctgccccagtgggcgtacatgcacatcgccggacaggacgcttcggagtacctgagtccgggtctggtgcagttcgcccgcgccacagacacctacttcagtctggggaacaagtttaggaaccccacggtggcgcccacgcacgatgtgaccaccgaccgcagccagcggctgacgctgcgcttcgtgcccgtggaccgcgaggacaacacctactcgtacaaagtgcgctacacgctggccgtgggcgacaaccgcgtgctggacatggccagcacctactttgacatccgcggcgtgctggatcgggggcccagcttcaaaccctactccggcaccgcctacaacagcctggctcccaagggagcgcccaacacttgccagtggacatataaagctggtgatactgatacagaaaaaacctatacatatggaaatgcacctgtgcaaggcattagcattacaaaggatggtattcaacttggaactgacagcgatggtcaggcaatctatgcagacgaaacttatcaaccagagcctcaagtgggtgatgctgaatggcatgacatcactggtactgatgaaaaatatggaggcagagctcttaagcctgacaccaaaatgaagccttgctatggttcttttgccaagcctaccaataaagaaggaggccaggcaaatgtgaaaaccgaaacaggcggtaccaaagaatatgacattgacatggcattcttcgataatcgaagtgcagctgccgccggcctagccccagaaattgttttgtatactgagaatgtggatctggaaactccagatacccatattgtatacaaggcaggtacagatgacagtagctcttctatcaatttgggtcagcagtccatgcccaacagacccaactacattggcttcagagacaactttatcggtctgatgtactacaacagcactggcaatatgggtgtactggctggacaggcctcccagctgaatgctgtggtggacttgcaggacagaaacaccgaactgtcctaccagctcttgcttgactctctgggtgacagaaccaggtatttcagtatgtggaatcaggcggtggacagttatgaccccgatgtgcgcattattgaaaatcacggtgtggaggatgaacttcctaactattgcttccccctggatgctgtgggtagaactgatacttaccagggaattaaggccaatggtgataatcaaaccacctggaccaaagatgatactgttaatgatgctaatgaattgggcaagggcaatcctttcgccatggagatcaacatccaggccaacctgtggcggaacttcctctacgcgaacgtggcgctgtacctgcccgactcctacaagtacacgccggccaacatcacgctgcccaccaacaccaacacctacgattacatgaacggccgcgtggtggcgccctcgctggtggacgcctacatcaacatcggggcgcgctggtcgctggaccccatggacaacgtcaaccccttcaaccaccaccgcaacgcgggcctgcgataccgctccatgctcctgggcaacgggcgctacgtgcccttccacatccaggtgccccaaaagtttttcgccatcaagagcctcctgctcctgcccgggtcctacacctacgagtggaacttccgcaaggacgtcaacatgatcctgcagagctccctcggcaacgacctgcgcacggacggggcctccatcgccttcaccagcatcaacctctacgccaccttcttccccatggcgcacaacaccgcctccacgctcgaggccatgctgcgcaacgacaccaacgaccagtccttcaacgactacctctcggcggccaacatgctctaccccatcccggccaacgccaccaacgtgcccatctccatcccctcgcgcaactgggccgccttccgcggctggtccttcacgcgcctcaagacccgcgagacgccctcgctcggctccgggttcgacccctacttcgtctactcgggctccatcccctacctcgacggcaccttctacctcaaccacaccttcaagaaggtctccatcaccttcgactcctccgtcagctggcccggcaacgaccgcctcctgacgcccaacgagttcgaaatcaagcgcaccgtcgacggagaggggtacaacgtggcccagtgcaacatgaccaaggactggttcctggtccagatgctggcccactacaacatcggctaccagggcttctacgtgcccgagggctacaaggaccgcatgtactccttcttccgcaacttccagcccatgagccgccaggtcgtggacgaggtcaactacaaggactaccaggccgtcaccctggcctaccagcacaacaactcgggcttcgtcggctacctcgcgcccaccatgcgccagggccagccctaccccgccaactacccctacccgctcatcggcaagagcgccgtcgccagcgtcacccagaaaaagttcctctgcgaccgggtcatgtggcgcatccccttctccagcaacttcatgtccatgggcgcgctcaccgacctcggccagaacatgctctacgccaactccgcccacgcgctagacatgaatttcgaagtcgaccccatggatgagtccacccttctctatgttgtcttcgaagtcttcgacgtcgtccgagtgcaccagccccaccgcggcgtcatcgaggccgtctacctgcgcacgcccttctcggccggcaacgccaccacctaagcctcttgcttcttgcaagatgacggcctgcgcgggctccggcgagcaggagctcagggccatcctccgcgacctgggctgcgggccctgcttcctgggcaccttcgacaagcgcttcccgggattcatggccccgcacaagctggcctgcgccatcgtcaacacggccggccgcgagaccgggggcgagcactggctggccttcgcctggaacccgcgctcccacacctgctacctcttcgaccccttcgggttctcggacgagcgcctcaagcagatctaccagttcgagtacgagggcctgctgcgtcgcagcgccctggccaccgaggaccgctgcgtcaccctggaaaagtccacccagaccgtgcagggtccgcgctcggccgcctgcgggctcttctgctgcatgttcctgcacgccttcgtgcactggcccgaccgccccatggacaagaaccccaccatgaacttgctgacgggggtgcccaacggcatgctccagtcgccccaggtggaacccaccctgcgccgcaaccaggaggcgctctaccgcttcctcaacgcccactccgcctactttcgctcccaccgcgcgcgcatcgagaaggccaccgccttcgaccgcatgaatcaagacatgtaatccggtgtgtgtatgtgaatgctttattcatcataataaacagcacatgtttatgccaccttctctgaggctctgactttatttagaaatcgaaggggttctgccggctctcggcatggcccgcgggcagggatacgttgcggaactggtacttgggcagccacttgaactcggggatcagcagcttcggcacggggaggtcggggaacgagtcgctccacagcttgcgcgtgagttgcagggcgcccagcaggtcgggcgcggagatcttgaaatcgcagttgggacccgcgttctgcgcgcgagagttacggtacacggggttgcagcactggaacaccatcagggccgggtgcttcacgctcgccagcaccgtcgcgtcggtgatgccctccacgtccagatcctcggcgttggccatcccgaagggggtcatcttgcaggtctgccgccccatgctgggcacgcagccgggcttgtggttgcaatcgcagtgcagggggatcagcatcatctgggcctgctcggagctcatgcccgggtacatggccttcatgaaagcctccagctggcggaaggcctgctgcgccttgccgccctcggtgaagaagaccccgcaggacttgctagagaactggttggtggcgcagccagcgtcgtgcacgcagcagcgcgcgtcgttgttggccagctgcaccacgctgcgcccccagcggttctgggtgatcttggcccggtcggggttctccttcagcgcgcgctgcccgttctcgctcgccacatccatctcgatcgtgtgctccttctggatcatcacggtcccgtgcaggcaccgcagcttgccctcggcctcggtgcacccgtgcagccacagcgcgcagccggtgctctcccagttcttgtgggcgatctgggagtgcgagtgcacgaagccctgcaggaagcggcccatcatcgtggtcagggtcttgttgctggtgaaggtcagcggaatgccgcggtgctcctcgttcacatacaggtggcagatacggcggtacacctcgccctgctcgggcatcagctggaaggcggacttcaggtcgctctccacgcggtaccggtccatcagcagcgtcatcacttccatgcccttctcccaggccgaaacgatcggcaggctcagggggttcttcaccgttgtcatcttagtcgccgccgccgaagtcagggggtcgttctcgtccagggtctcaaacactcgcttgccgtccttctcggtgatgcgcacggggggaaagctgaagcccacggccgccagctcctcctcggcctgcctttcgtcctcgctgtcctggctgatgtcttgcaaaggcacatgcttggtcttgcggggtttctttttgggcggcagaggcggcggcggagacgtgctgggcgagcgcgagttctcgctcaccacgactatttcttctccttggccgtcgtccgagaccacgcggcggtaggcatgcctcttctggggcagaggcggaggcgacgggctctcgcggttcggcgggcggctggcagagccccttccgcgttcgggggtgcgctcctggcggcgctgctctgactgacttcctccgcggccggccattgtgttctcctagggagcaagcatggagactcagccatcgtcgccaacatcgccatctgcccccgccgccgccgacgagaaccagcagcagcagaatgaaagcttaaccgccccgccgcccagccccacctccgacgccgcagccccagacatgcaagagatggaggaatccatcgagattgacctgggctacgtgacgcccgcggagcacgaggaggagctggcagcgcgcttttcagccccggaagagaaccaccaagagcagccagagcaggaagcagagagcgagcagaaccaggctgggctcgagcatggcgactacctgagcggggcagaggacgtgctcatcaagcatctggcccgccaatgcatcatcgtcaaggacgcgctgctcgaccgcgccgaggtgcccctcagcgtggcggagctcagccgcgcctacgagcgcaacctcttctcgccgcgcgtgccccccaagcgccagcccaacggcacctgcgagcccaacccgcgcctcaacttctacccggtcttcgcggtgcccgaggccctggccacctaccacctctttttcaagaaccaaaggatccccgtctcctgccgcgccaaccgcacccgcgccgacgccctgctcaacctgggccccggcgcccgcctacctgatatcgcctccttggaagaggttcccaagatcttcgagggtctgggcagcgacgagactcgggccgcgaacgctctgcaaggaagcggagaggagcatgagcaccacagcgccctggtggagttggaaggcgacaacgcgcgcctggcggtcctcaagcgcacggtcgagctgacccacttcgcctacccggcgctcaacctgccccccaaggtcatgagcgccgtcatggaccaggtgctcatcaagcgcgcctcgcccctctcggaggaggagatgcaggaccccgagagctcggacgagggcaagcccgtggtcagcgacgagcagctggcgcgctggctgggagcgagtagcaccccccagagcctggaagagcggcgcaagctcatgatggccgtggtcctggtgaccgtggagctggagtgtctgcgccgcttcttcgccgacgcggagaccctgcgcaaggtcgaggagaacctgcactacctcttcagacacgggttcgtgcgccaggcctgcaagatctccaacgtggagctgaccaacctggtctcctacatgggcatcctgcacgagaaccgcctggggcagaacgtgctgcacaccaccctgcgcggggaggcccgccgcgactacatccgcgactgcgtctacctgtacctctgccacacctggcagacgggcatgggcgtgtggcagcagtgcctggaggagcagaacctgaaagagctctgcaagctcctgcagaagaacctcaaggccctgtggaccgggttcgacgagcgcaccaccgccgcggacctggccgacctcatcttccccgagcgcctgcggctgacgctgcgcaacgggctgcccgactttatgagccaaagcatgttgcaaaactttcgctctttcatcctcgaacgctccgggatcctgcccgccacctgctccgcgctgccctcggacttcgtgccgctgaccttccgcgagtgccccccgccgctctggagccactgctacctgctgcgcctggccaactacctggcctaccactcggacgtgatcgaggacgtcagcggcgagggcctgctcgagtgccactgccgctgcaacctctgcacgccgcaccgctccctggcctgcaacccccagctgctgagcgagacccagatcatcggcaccttcgagttgcaaggccccggcgagggcaaggggggtctgaaactcaccccggggctgtggacctcggcctacttgcgcaagttcgtgcccgaggactaccatcccttcgagatcaggttctacgaggaccaatcccagccgcccaaggccgagctgtcggcctgcgtcatcacccagggggccatcctggcccaattgcaagccatccagaaatcccgccaagaatttctgctgaaaaagggccacggggtctacttggacccccagaccggagaggagctcaaccccagcttcccccaggatgccccgaggaagcagcaagaagctgaaagtggagctgccgccgccgccggaggatttggaggaagactgggagagcagtcaggcagaggaggaggagatggaagactgggacagcactcaggcagaggaggacagcctgcaagacagtctggaggaggaagacgaggtggaggaggcagaggaagaagcagccgccgccagaccgtcgtcctcggcggaggaggagaaagcaagcagcacggataccatctccgctccgggtcggggtcgcggcggccgggcccacagtagatgggacgagaccgggcgcttcccgaaccccaccacccagaccggtaagaaggagcggcagggatacaagtcctggcgggggcacaaaaacgccatcgtctcctgcttgcaagcctgcgggggcaacatctccttcacccggcgctacctgctcttccaccgcggggtgaacttcccccgcaacatcttgcattactaccgtcacctccacagcccctactactgtttccaagaagaggcagaaacccagcagcagcagcagcagcagaaaaccagcggcagcagctagaaaatccacagcggcggcaggtggactgaggatcgcggcgaacgagccggcgcagacccgggagctgaggaaccggatctttcccaccctctatgccatcttccagcagagtcgggggcaagagcaggaactgaaagtcaagaaccgttctctgcgctcgctcacccgcagttgtctgtatcacaagagcgaagaccaacttcagcgcactctcgaggacgccgaggctctcttcaacaagtactgcgcgctcactcttaaagagtagcccgcgcccgcccacacacggaaaaaggcgggaattacgtcaccacctgcgcccttcgcccgaccatcatcatgagcaaagagattcccacgccttacatgtggagctaccagccccagatgggcctggccgccggcgccgcccaggactactccacccgcatgaactggctcagtgccgggcccgcgatgatctcacgggtgaatgacatccgcgcccaccgaaaccagatactcctagaacagtcagcgatcaccgccacgccccgccatcaccttaatccgcgtaattggcccgccgccctggtgtaccaggaaattccccagcccacgaccgtactacttccgcgagacgcccaggccgaagtccagctgactaactcaggtgtccagctggccggcggcgccgccctgtgtcgtcaccgccccgctcagggtataaagcggctggtgatccgaggcagaggcacacagctcaacgacgaggtggtgagctcttcgctgggtctgcgacctgacggagtcttccaactcgccggatcggggagatcttccttcacgcctcgtcaggccgtcctgactttggagagttcgtcctcgcagccccgctcgggtggcatcggcactctccagttcgtggaggagttcactccctcggtctacttcaaccccttctccggctcccccggccactacccggacgagttcatcccgaacttcgacgccatcagcgagtcggtggacggctacgattgaatgtcccatggtggcgcggctgacctagctcggcttcgacacctggaccactgccgccgcttccgctgcttcgctcgggatctcgccgagtttgcctactttgagctgcccgaggagcaccctcagggcccggcccacggagtgcggatcgtcgtcgaagggggtctcgactcccacctgcttcggatcttcagccagcgtccgatcctggccgagcgcgagcaaggacagacccttctgaccctgtactgcatctgcaaccaccccggcctgcatgaaagtctttgttgtctgctgtgtactgagtataataaaagctgagatcagcgactactccggacttccgtgtgttcctgctatcaaccagtccctgttcttcaccgggaacgagaccgagctccagctccagtgtaagccccacaagaagtacctcacctggctgttccagggctctccgatcgccgttgtcaaccactgcgacaacgacggagtcctgctgagcggccctgccaaccttactttttccacccgcagaagcaagctccagctcttccaacccttcctccccgggacctatcagtgcgtctcgggaccctgccatcacaccttccacctgatcccgaataccacagcgtcgctccccgctactaacaaccaaactacccaccaacgccaccgtcgcgaccgcggacatgtacagagctcgagaagtactaggccacaatacatgcccatattagactatgaggccgagccacagcgacccatgctccccgctattagttacttcaatctaaccggcggagatgactgacccactggccaacaacaacgtcaacgaccttctcctggacatggacggccgcgcctcggagcagcgactcgcccaacttcgcattcgccagcagcaggagagagccgtcaaggagctgcaggacggcatagccatccaccagtgcaagaaaggcatcttctgcctggtgaaacaggccaagatctcctacgaggtcaccccgaccgaccatcgcctctcctacgagctcctgcagcagcgccagaagttcacctgcctggtcggagtcaaccccatcgtcatcacccagcagtcgggcgataccaaggggtgcatccactgctcctgcgactcccccgactgcgtccacactctgatcaagaccctctgcggcctccgcgacctcctccccatgaactaatcacccccttatccagtgaaataaatatcatattgatgatgatttaaataaaaaataatcatttgatttgaaataaagatacaatcatattgatgatttgagttttaaaaaataaagaatcacttacttgaaatctgataccaggtctctgtccatgttttctgccaacaccacctcactcccctcttcccagctctggtactgcagaccccggcgggctgcaaacttcctccacacgctgaaggggatgtcaaattcctcctgtccctcaatcttcattttatcttctatcagatgtccaaaaagcgcgtccgggtggatgatgacttcgaccccgtctacccctacgatgcagacaacgcaccgaccgtgcccttcatcaacccccccttcgtctcttcagatggattccaagagaagcccctgggggtgctgtccctgcgactggctgaccccgtcaccaccaagaacggggaaatcaccctcaagctgggagagggggtggacctcgactcctcgggaaaactcatctccaacacggccaccaaggccgccgcccctctcagtttttccaacaacaccatttcccttaacatggatacccctctttataccaaagatggaaaattatccttacaagtttctccaccgttaaacatattaaaatcaaccattctgaacacattagctgtagcttatggatcaggtttaggactgagtggtggcactgctcttgcagtacagttggcctctccactcacttttgatgaaaaaggaaatattaaaattaacctagccagtggtccattaacagttgatgcaagtcgacttagtatcaactgcaaaagaggggtcactgtcactacctcaggagatgcaattgaaagcaacataagctggcctaaaggtataagatttgaaggtaatggcatagctgcaaacattggcagaggattggaatttggaaccactagtacagagactgatgtcacagatgcatacccaattcaagttaaattgggtactggccttacctttgacagtacaggcgccattgttgcttggaacaaagaggatgataaacttacattatggaccacagccgacccctcgccaaattgcaaaatatactctgaaaaagatgccaaactcacactttgcttgacaaagtgtggaagtcaaattctgggtactgtgactgtattggcagtgaataatggaagtctcaacccaatcacaaacacagtaagcactgcactcgtctccctcaagtttgatgcaagtggagttttgctaagcagctccacattagacaaagaatattggaacttcagaaagggagatgttacacctgctgagccctatactaatgctataggttttatgcctaacataaaggcctatcctaaaaacacatctgcagcttcaaaaagccatattgtcagtcaagtttatctcaatggggatgaggccaaaccactgatgctgattattacttttaatgaaactgaggatgcaacttgcacctacagtatcacttttcaatggaaatgggatagtactaagtacacaggtgaaacacttgctaccagctccttcaccttctcctacatcgcccaagaatgaacactgtatcccaccctgcatgccaacccttcccaccccactctgtctatggaaaaaactctgaagcacaaaataaaataaagttcaagtgttttattgattcaacagttttacaggattcgagcagttatttttcctccaccctcccaggacatggaatacaccaccctctccccccgcacagccttgaacatctgaatgccattggtgatggacatgcttttggtctccacgttccacacagtttcagagcgagccagtctcgggtcggtcagggagatgaaaccctccgggcactcccgcatctgcacctcacagctcaacagctgaggattgtcctcggtggtcgggatcacggttatctggaagaagcagaagagcggcggtgggaatcatagtccgcgaacgggatcggccggtggtgtcgcatcaggccccgcagcagtcgctgccgccgccgctccgtcaagctgctgctcagggggtccgggtccagggactccctcagcatgatgcccacggccctcagcatcagtcgtctggtgcggcgggcgcagcagcgcatgcggatctcgctcaggtcgctgcagtacgtgcaacacaggaccaccaggttgttcaacagtccatagttcaacacgctccagccgaaactcatcgcgggaaggatgctacccacgtggccgtcgtaccagatcctcaggtaaatcaagtggcgctccctccagaacacgctgcccacgtacatgatctccttgggcatgtggcggttcaccacctcccggtaccacatcaccctctggttgaacatgcagccccggatgatcctgcggaaccacagggccagcaccgccccgcccgccatgcagcgaagagaccccgggtcccggcaatggcaatggaggacccaccgctcgtacccgtggatcatctgggagctgaacaagtctatgttggcacagcacaggcatatgctcatgcatctcttcagcactctcagctcctcgggggtcaaaaccatatcccagggcacggggaactcttgcaggacagcgaaccccgcagaacagggcaatcctcgcacataacttacattgtgcatggacagggtatcgcaatcaggcagcaccgggtgatcctccaccagagaagcgcgggtctcggtctcctcacagcgtggtaagggggccggccgatacgggtgatggcgggacgcggctgatcgtgttcgcgaccgtgtcatgatgcagttgctttcggacattttcgtacttgctgtagcagaacctggtccgggcgctgcacaccgatcgccggcggcggtcccggcgcttggaacgctcggtgttgaaattgtaaaacagccactctctcagaccgtgcagcagatctagggcctcaggagtgatgaagatcccatcatgcctgatagctctgatcacatcgaccaccgtggaatgggccagacccagccagatgatgcaattttgttgggtttcggtgacggcgggggagggaagaacaggaagaaccatgattaacttttaatccaaacggtctcggagcacttcaaaatgaaggtcgcggagatggcacctctcgcccccgctgtgttggtggaaaataacagccaggtcaaaggtgatacggttctcgagatgttc

SEQ ID NO: 9 - protein, 11007 aa, Artificial Sequence
  Artificially Synthesized
HHQYTSNFWCALICKAVIWGGRKVIGCGSGDRGRGGRFDDVAMRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLRLEFDATMRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVEIKPLGVAPTKSKLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWGTSRVDPGGQTADQPRLCLLVASHLLFAPPPCLPPWKVPLPLSFPNKMRKLHRIVVGVILFWGVGWGRTARGRIGKTIAGMLGMRWALWLLRRKEPADLQIIHLCRVRRKRNGIMGIMGLHIGQISTYAGHRACGLAPPQDMARVRAQRHDPLQCAPGLPPRHVHALPVQHAICEGAAGARCHVQSEPDGGVHECGAVENSEIIQDQVPGLRMRRQARQASARVCGGDGGPATRSFGVVLQRDGVRLQRGRILEVVFGAGCEPAGAELKSVVFCVLQQHERKRLLGRGIQPLSDGASPLLGGSASECDGIHGGRPARAARELFNPDLRDPELLVRGRSCRRSCCFRRQRRARNGPGRRLLQLSGGQLEFHQSRQPERGEAAAADGPARGPDPAPGRADPAGGSAAGGDAGRGCHGENQIKNESINKRRRLLILTQSLESLFDFSRAVGPGPPVSIIEHPVDLFQDPVEVGLDVEVHGHEPVPGVEVAPLQGLVLGDGVVNHPVIAGAQGVVLHDVLEEETDGHGQPLGVGVDEPVELGGMHAGGDEMHLGLDLEIGDVPAQIPPGVHVVQDHQHGVSGALGEFVMQLGREGVKEFGDALVTAQVFHALIHDDGDGPVGGGLGKDVSGVGHIVVVVLGELVIGHFNEFGAEGARLGDEGALDPGGVVALADLHLPGLELGGGDHVHLRGDEKNGFRGGGDELGRKQVPEQLGLAATGGAVDDPDDRLQVVVEGETAAVLAEEGGHLVHHLAHMHVLAHEFRQEALAPQREELLQRGEVFQRLESVGHGHFGEGLLQEFQTVPELGDVLGISIQQTSSFRGLGRLREGTRRWASSEARVRSFQGRRVRVSVVSVTVKGCAPGWALARVRFRLIRLVENRSRSAPCASARQLSMSSLSASAAWPLARSLPLEVCPQTGQRRDLRASLGARKTDSGAASAPQLAQTVSHSTSQVRSGRLGSKTRFPPCFLMRFLPLVSMSSCPRWVTKRLSVSPTDFMGRSSSGVPRSSSRNPAHSETKARVQASTKEATWEGRSLSTSGSTFSRVCKHMSPSSTSRKVIGLVATPGVPAGGVKGAGPCSSSLSSGSLSRSASCWGRYSLSKAGMTSALRLSVSRNEEDLILTVPLETPFMSPSSIWSEKTIFLLSSLVAKEPRALESSLAMERMVWFFSLSARSLAAMLSCTYSRATHFHSGKTVVSSSGTILTRQPRLCRVMRSTLVATSPRRGSLVQQRRPPLREQKGGSGSSMSSSGGSASTVKMPGRSSGSKLMQVPRLSSAACQSRTASARSGLRGVPQGMGCVSAEAYMPQMSTRGSSRTPMVGQRPPRMLARTSYSSCEGARSPVPRLERCGFSARTIWRKMAWELEEMVGLWKMLKWAWGRPTESLMKWAESCSLATSSAVTRTSRAQSRVSWMMSYLSWPFCFHSSRLRRNSSRSFQYSSRGNPSSAREPTMNWLTALAQQPFSTGRAACAALRREVWVRAKVSRTMTLRNWCLKSRSSQPPCSQSWKSVRFLAGLGKAKVTSLKRILPARGMKLRVMRKGWGTSARLLMTWAARTISSKPLMLCPTMSSTNRGRPLTWGSFLSSSVSSAGSLSPCCSRAQSATWGLALRKEVQRSTARAVCKRSRYRNCWPTAIFSGVTQKVRGSPCQRSHLSWRARSWASSTSGGSPESFMTSMKGTSCLPKDPIQVVSTSVRKSLSVRGCEPMGKNWISCHQLEEWLLMWKKCRRRAEHSCLCLYKRPQCSQRCTGCTCCTSCTWVPLARNFSGQWSAGGCISCCTTSWPSAWPSSASMVVMLTSPRGRQVQTSARTGRRARTRARRPELSRVLRRCGVRSVGSGGARLTCRSFSRARGRSRWYLISTAPLVATSTACRVPCPWGATTVPRFFLGAASMSVRSGGEDARRAAGAARGPEAGAAGARRRRARAGSGTAPGEDWRERRRDGRPGSDASGRPRDPVTKRVRQNQSRYRRRPAAGSLARRPSCPGRRSRSTARSPPPEGLRGRRARRWPRGRWRCGPAARRRSCRPRSRRGCRPRLRRGRARAPPGRGARRGARPRSCRGAGRGSAWWRCARRRSTSSGGAASRRRPGLPSVPWPRRSPRRSKTGSCAPRRSTPPPEDGARRWWRAPRARRPRGAPLPSPPLPPPLTSLLLPPQEAVAGEGPCVAGGARADGRSARWSPRAGDAWSRRRARPRGAAARRRRASPGGRRGGLRWAGRGRRCILSIDPGLRARTASRDPRDPKTAERRLRASRSRKVGARFLVLRVFGREAGGRCCWSSRRSDGGWWRGAPGPWARLAGCADGRPCPRRGPDTWRGPCSSPAAAPRAPPPRPRGRACAARTRAAAGRAPGRRRRARGWPAGSGGWSGSRRSRRSGGRLRCWCRSSWPRTSRSGGRVARARGTGASRRACRRCSRCRRARGTGIRRGSAAAAGGRAAIARWRGRRARGPRAGGGSRRCTWTSRCRRRWWRRAGTRGRGSRCCAAAGSSSWWPRSGPGARSRGCSRHTGKNESGQRLDSVAWRLSERVGLRVYPGSNLESGWSRSRGTGTPVSTQACRNLQDTEAGRFLALVAGHEKLVSAESGRPRWLAAVVWRKNRQGCVAVCPGSSLSARRRPDSAANVGVAAPSFPRPLSQPTSPVTERAPLFFSCVFARCIPYCGRCAPTLHHNRPYRSSSNSRRFCPRPSSSQPLPRRPPAEPAFSMTWPWKRARGWRGWGRRRRSGTRACRKGTLARPTCPSRTCSETGAARSPRRCAPPASTRGGSCGAAWTESGCGTRISRRTSRGSAPRARTWPRPTWSRRTSRPRRRATSKNPSTTTCARSRARRPWACTCGTCWRPSCRTPRASRRRSCFWWCSTVGTTRRSGRRCISPSPRAAGSWTWTFCRASWCRSAGCRCPRSWRPSTSRCVWASTTLGRSTRPRTCPTRRRSTGFTCAPKCPATIWGCTATTGCTARAPAAGASATRSCTACSGPPGPGPRGRATLTWARTCAGSPAAGPWKLPAVPPTWRRWTMRRRRASTWKTDGATVFLLDAATATAAASSRDAGGAAEPAVRHLLGRLDPGHATHHGADDPQSRSLTAASGQPALGHPGGRGALALEPHAREGAGHRERAGGEQGHPRRGRAGVQRAAGARGPLQQHQRADEPGPHGDRRARGGVAARAVPPRVEPGLHGGAERLPEHAARQRAPGPGGLHQLHQRAAADGGRGAPERGVPVGAGLLLPDQSPGLADREPEPGFQELAGTVGRAGPGRGPRDGVEPADAELAPAAAAGGALHGQRQREPRLVPGLPAPVPRGHRTGARGRADLPGDHPREPRAGPGGPGQPGGHPELPADQPVAEDPAPVRAEHRGGAHPALRAAERGAVPDAGGGHAQRGARHDRAQHGAQHVRPQPPVHQADGLLASGGRHELGLLYQRHLEPALAPAARVLHGRVRHARPQRRVPVGRRGQQRVLAASRNQCRVEERGRGPAAVLGAVRSRGCCRGGARGRQPLPEPALFAEQRAQQRAGSADATAPAGRGGVPERLLVEARAREELPQRDREPGGQDEPLEDVRARAQGRAPSQRRHPTPAARQAAGTGVGRGFRRRQQRVGLGWEWWPVRSPAPPYRAPDVRIKNKRRYSPRPWRPACVLLCCLYDEARVPGGSSSLVRERDAAGGGGGDAAPAGGALRAPAVPGAYGGAEQHSLLGAGTLVRYHPVVPGGQQVGRHRLAELPERPQQLPDHRGAEQRFHPHGGQHPDHQLRALAVGRPAENHHAHQHAQRERVHVQQQVQGAGDGLAQDPQRGGLWSGRADLRVGGVAARGQLLGDHDHRSDEQRHHRQLLGGGAAERGAGERHRREVRHAQLPAGLGPRDRAGDAGRVHQRGLPPRHRPAARLRRGLHREPPQQPAGHPQAAALPGGLPDPVRGPGGGQHPRALGCRSLREKQGGHRRGDRSRGHRLYRGAGRFCRCGSGRGGNRKDSHPAGGEGQQGQELQRARGQEKHRLPQLVPGLQLRRPREGRALLDAAHHLGRHLRRGASLLVAARHDARPGHLPLHASSQLPGGGRRAPARLLQELLQRAGRLLAAAARLHLAHARLQPLPREPDPRPPARAHHYHRQKRSCSHRSRDPAAAQQYPGSPARDRHRQTPHLPLRLQGPGRSRAARPLEPHLLKNVHSHLAQHRLGPARAQQDVRRRSPTLHATPRARARALPRSLGRPQGPRALAHHRRRRDRPGGGRRAQLHARRRARLHRGRRHRQRGGRRAPVRPHQEPAAAHRPAAPEHPRHARGASLAAQGQAHGTQGHAQGGQTRGLRQQQRRQDPQTRGHGGGGGHRQHVPPAARQRVLGARRRHRCARARAHPPPSHLKMLTSRCCVPAARRMSKRKYKEEMLQVIAPEIYGPAAAVKEERKPRKLKRVKKDKKEEEDDGLVEFVREFAPRRRVQWRGRKVKPVLRPGTTVVFTPGERSGSASKRSYDEVYGDEDILEQAVERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTSTRRRRKYGAASLLMPNYALHPSIIPTPGYRGTRFYRGYTSSRRRKTTTRRRRRSRRSSTATSALVRRVYRSGREPLTLPRARYHPSIAILPPPTCRYGPHMPPPRPHYGLPRKKAAPKADGERAASPSPPAAARHQQAVGGRLPARADPHHRRGDRGDPRHSFRGGAGLSAPLRHKKAWICNKKKNGLTLLVLCVFLDGRHQFFVPGTATRHAAVYGHLERHRQQPTERGRLQLEQSLERAEFRVHAQNLWQQGVEQQHRAGAEGKAERTELPAEGGWPGLRHQRGGPGQPGRAETDQQPPGRGPARGVRGDAPGGGGAASPGQARRQATASRRGGDAADAHGRAAPVRGGGETGPAHHAARGASGHRSAETQQQPARDPGLASASPLHSGAPAAGGRRVARPPRPPPGELAEHSEQHRGSGSAECEAPPLLLKDTVALNLLVCVYMYVRRPEGGVRGASPSCKMATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQAKTGNGGTMETHTYGVAPMGGENITKDGLQIGTDVTANQNKPIYADKTFQPEPQVGEENWQETENFYGGRALKKDTNMKPCYGSYARPTNEKGGQAKLKVGDDGVPTKEFDIDLAFFDTPGGTVNGQDEYKADIVMYTENTYLETPDTHVVYKPGKDDASSEINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKDGQDGDVESEWENDDTVAARNQLCKGNIFAMEINLQANLWRSFLYSNVALYLPDSYKYTPTNVTLPTNTNTYDYMNGRVTPPSLVDAYLNIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATTAALASCKMTAGSGEQELRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDMKTGVCMMLYSTAHVYATFSEALTLFRNRRGSAGSRHGPRAGIRCGTGTWAATTRGSAAWARGGRGTSRSTACAVAGRPAGRARRSNRSWDPRSARESCGTRGCSTGTPSGPGASRLPAPSRRCPPRPDPRRWPSRRGSSCRSAAPCWARSRACGCNRSAGGSASSGPARSSCPGTWPSKPPAGGRPAAPCRPRRRPRRTCRTGWWRSRRRARSSARRCWPAAPRCAPSGSGSWPGWGSPSARAARSRSPHPSRCAPSGSSRSRAGTAACPRLRCSRAATARSRCTPSSCGRSGSASARSPAGSGPSSRSGSCCWRSAGCRGAPRSHTGGRCGGTPRPARASAGRRTSGRSPRGTGPSAASSLPCPSPRPKRSAGSGGSSPPLSSSPPPRSGGRSRPGSQTLACRPSRCARGESSPRPPAPPRPAFRPRCPGCLAKAHAWSCGVSFWAAEAAAMCWESASSRSPRLFLLLGRRPRPRGGRHASSGAEAEATGSRGSAGGWQSPFRVRGCAPGGAALTDFLRGRPLCSPREQQQAWRLSHRRQHRHLPPPPPPTRTSSRMKAPPRRPAPPPTPRPQTCKRWRNPSRLTWATRPRSTRRSWQRAFQPRKRTTKSSQSRKQRTSRTRLGTSMATTAGQRTCSSSIWPANASSSRTRCSTAPRCPSAWRSSAAPTSATSSRRACPPSASPTAPVSPTRASTSTRSSRCPRPWPPTTSFSRTKGSPSPAAPTAPAPTPCSTWAPAPAYLISPPWKRFPRSSRVWAATRLGPRTLCKEAERSMSTTAPWWSWKATTRAWRSSSARSSPTSPTRRSTCPPRSAPSWTRCSSSAPRPSRRRRCRTPRVRTRASPWSATSSWRAGWERVAPPRAWKSGASSWPWSWPWSWSVCAASLPTRRPCARSRRTCTTSSGTGSCARPARSPTWSPTWSPTWASCTRTAWGKTCCTPPCAGRPAATTSATASTCTSATPGRRAWACGSSAWRSRTKSSASSCRRTSRPCGPGSTSVPPPRTWPTSSSPSACGRCATGCPTLAKACCKTFALSSSNAPGSCPPPAPRCPRTSCRPSASAPRRSGATATCCAWPTTWPTTRTSRTSAARVCWSATAAATSARRTAPWPATPSCARPRSSAPSSCKAPATARARGVNSPRGCGPRPTCASSCPRTTIPSRSGSTRTNPSRPRPSCRPASSPRGPSWPNCKPSRNPAKNFCKRATGSTWTPRPERSSTPASPRMPRGSSKKLKVELPPPEDLEEDWESSQAEEEEMEDWDSTQAEEDSLQDSLEEEDEVEEAEEEAAAARPSSSAEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQKTSGSSSKIHSGGRWTEDRGERAGADPGAEEPDLSHPLCHLPAESGAGAGTESQEPFSALAHPQLSVSQERRPTSAHSRGRRGSLQQVLRAHSRVARARPHTEKGGNYVTTCALRPTIMSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYDMSHGGAADLARLRHLDHCRRFRCFARDLAEFAYFELPEEHPQGPAHGVRIIVEGGLDSHLLRIFSQRPILVEREQGQTLLTLYCICNHPGLHESLCCLLCTEYNKSDQRLLRTRLWCSCYQPVPVLHRERDRAPAPVAPQEVPHLAVPGLPDRRCQPLRQRRSPAERPCQPYFFHPQKQAPALPTLPPRDLSVRLRTLPSHLPPDPEYHSAAPRYQPNYPPTPPSRPFLIYHYRRWLLLLVLPRPVDPRSPTQSPEEVRKCKFQEPWKFLKCYRQKSDMHPSWIMIIGIVNILACTLISFVIYPCFDFGWNSPEALYLPPEPDTPPQQQPQAHALPPPQPRPQYMPILDYEAEPQRPMLPAISYFNLTGGDDPTGQQRQRPSPGHGRPRLGAATRPTSHSSAAGESRQGAAGRHSHPPVQERHLLPGETGQDLLRGHPDRPSPLLRAPAAAPEVHLPGRSQPHRHHPAVGRYQGVHPLLLRLPRLRPHSDQDPLRPPRPPPHELITPLSSEIKIILMMIIKKIIIFEIKIQSYFEFNKNKESLTNLIPGLCPCFLPTPPHSPLPSSGTAGPGGLQTSSTRRGCQIPPVPQSSFYLLSDVQKARPGGLRPRLPLRCRQRTDRALHQPPLRLFRWIPREAPGGVVPATGPRHHQERGNHPQAGRGGGPRLVGKTHLQHGHQGRRPSQYFKQHHFPNCCPFLQQQWNFKPQCLHTISSISHIHFRHKSWKRSSDFKVVDCTTNSSSYIQLKHHSKNRQRAIYLQWKQRTGYKPKKRTSFRCYCNIYWKWLRLWILWKNKTRNYQNWSRIKFCQSNSCQTRHRFKFLRWCLDSWKQTGQANTLDYPPKPLSITFRQRCQIYSLSYKMRSNTRHCGSGGCYCRISTKSNHSQKRHSFPIFRWCTHVKLINGRLLELGGTDHSKCSLYKCCGIHAKYRCISKNPKNTKHSQSGIFNWRNYYANDTNHNFQWHKRHNPSHLLYDFYMAVDWRLGQKYYLCYQLILFFLHRPGIIPPSKPTPFPTTFVYMETLKQKNKVQVFYINSFTGLEQLFFLHPPRTWNTPPSPPAQPTSECHWWTCFWSPRSTQFQSEPVSDRSGRNPPGTPASAPHSSTAEDCPRWSGSRLSGRSRRAAVGIIVRERDRPVVSHQAPQQSLPPPLRQAAAQGVRVQGLPQHDAHGPQHQSSGAAGAAAHANLAQVTAVRATQDHQVVQQSIVQHAPAETHRGKDATHVAVVPDPQVNQVALPPEDAAHVHDLLGHVAVHHLPVPHHPLVEHAAPDDPAEPQGQHRPARHAAKRPRIPAMTMEDPPLVPVDHLGAEQVYVGTAQAYAHASLQHSQLLGGQNHIPGHGELLQDSEPRRTGQSSHITYIVHGQGIAIRQHRVILHQRSAGLGLLTAWGGRPIRVMAGRGSCSRPCHDAVAFGHFRTCCSRTWSGRCTPIAGGGLGAWNARCSCKTATLSDRAADLGPQERSHHALSHRPPWNGPGPARCNFVGFRRRGREEQEEPLTFNPNGLGALQNEGHGDGTSRPRCVGGKQPGQRYGSRDVPRWLPAKPPRAHPETRQRKREGSLIPQPSCYTPAPSPDNFHFSSLEFELVPEVNPSQPKARAEHPPPAFLSTPSFQDILLLVHLQQIDKRNIKISAAIPELLPQQLVLFHIVSEIFSHRTPRNKRRASHITDKPKSPPVSIAKCKIEISMLARPGDIFQITGQKIGAIFKKINKRKIFQVHVGLGNNDGVSARGAFQHGLADLKNKKNIKPCPGEQVGKSFSPAPGRPRGLRRDPRKNCRYDKPSQRDVPGGRREFEKKHTPPEHWSPVKKSGRGSNEALQRSLSSPAKRCHADEAQNFQVRKKCNYSPPAQAAKLPIPPDTHTKPQRPLTERQQQRHTTGARVREKTELPVRPLSAQYIAPDLHRKGQSLKIPAKSHTPSTRPETGDTLRKIRALPQTAKLPSFPGSHATSSKHDFQIPSTVKNITRPAPNGRRSRSQSPSSLPKFKQLICILTRTKSLRYIIDD

SEQ ID NO: 10 - protein, 10774 aa, Artificial Sequence
  Artificially Synthesized
HHQYTSNFWCALICKAVIWGGRKVIGCGSGDRGRGGRFDDVAMRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSYSITGSLVHSPYMEFRVTLTVNGPPGPPNDPRPLTSIMTYVPIVTPIGTFHRQWVEYLRTAHLAVHQVYHMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLSCRSWSGTGQVSIKVTRQVGDQKLGLSRQRRLLRFAPIGLTDIHFAFLSTGVHSQFNYSSGSTYDSLASATMGARASVLSGGELDRWEKIRLRPGGKKKYKLKHIVWASRELERFAVNPGLLETSEGCRQILGQLQPSLQTGSEELRSLYNTVATLYCVHQRIEVKDTKEALEKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQSSVTGPLESTRAAKPLISLDCAFLPAICCLPLPRAFLDPGRCHSHCPFLIKGNCIALSEVSFYSGGWGGAGQQGGGLGRQQACWGCGGLYGFGGKNQQICRSEFIYVGCGERGNEMVLWVLWVCINESVRYRHMLATVHVASHPRKTWPEFEHNVMTRCNVHLGSRRGMFMPYQCNMQFVKVLLEPDAMSRVSLTGVFDMNVELWKILRYDESKTRCRACECGGKHARLQPVCVEVTEDLRPDHLVLSCNGTEFGSSGEESDSECLGLGVSLHEGQNDNLWFSVCCSSMSGSASFEGGVFSPYLTGRLPSWAGVRQNVMGSTVDGRPVQPANSSTLTYATLSSSSVDAAAAAAAASAASAVRGMALGAGYYSSLVANSSSTNNPASLNEEKLLLLMAQLEALTQRLGELTQQVAQLQAETRAAVATVKTKKMNQINGDGCFHRVLNLYLIFRARALDHRSRSLSTRWIFSRTRRWAWMLRYMGMSPSRGWRLHCRASCSGMVLITQSQGRRAWCCTMSLRRRLMATGSPLVVLTNLLSWEGCMRGEMRCILAWILRLAMFPPRSRRGFMLCRTTSTVYPVHLGNLSCNLEGKAKNLETPLPPRFSMHSSMMMAMGPWAAAWAKTFRGSDTSLWSWVSSSAILMNLGRRVPDWGTKVPSIPGALPSQICISQALSSEGGIMSTCGAMKKTVSGAGEMSWAESRFRSSWDLPQPVGPMTPMTGCRWLRERQLPSSRRRGATSFIISRTCMFSRTSSARRRSPPSERSSCSEAKFFSGLSPSAMGILERVCCKSSRRSQSSVMCSRASRSSRPPRFAGWGDCGSRAPGDGRPARPGSGPSRAAGSASAWSPSRRGARRAGRLRGCASGSSGWSRTAPGRRPARRPGSNAVRSAPRPRGPWRGAYLWKCVRRRDRGGTGRRAWGRGRRTRGRRRPRRSWRRRSRTPRARGRGGWGQKRGFLRAFCVSYLWSPARVPAGQRGCPCPRRPTLWAGPRAGCRGPRRRGTPPTPRRRPGSRPARRRPRGRGSGRCPPAGPPSPGYASTCPPRPHPGRLACKCRPRDRGSRPGGYKRGRAPARPHCLPDRCPGAPAVGVGIPSRRRAPRHSGCQFLETRRIYRCRWRRLSAPRPFGQKRRSFCCRAWWRRSRRGRWRAAWRWSAWSGSFPCRRAPWRRCAARTRAPRTSIRGRRWARRARFPASRGCAGGPRWWPPRRAGARWSSRGARPCASRRGAAGPAARRGGRRPRRCRAGARGRSSCRCPDCPAPLASRARPARARRGGACPRAWGAARRRTCRRCRRRRGAPRGRRCRWGSSAPRGCWRARSRTARARARGAPCRGWSVAAFRRGRRSGGRWRGSWRRWWAFGRCSGRGAGRPSPSGRRSPAAWRRARRRGRPGRSSRGSLGCHTAGPSASTARGEGTLRGPSSTLRGGTRPDRHGKSPPCRTGRPCRRSSPSPRGGRKLARPCAGRCGGRRCRAPPGTGASRGRRSRPAPRVGSPCASCRRGAKRKHRRGSCPRGASCECGKAGAPRPGCPGRRGRSRRSRCCARRCRVPRIAGGPRGAASARRRARRGRARAARGPSRRRGGWRGRKSRDPRPGRSASGPGTDGTVGPRPFFRGRSRRCGGRRASGPTAGGRGRGRARRAAGPRRVSPARGRAACRRTPSRCRFPHRRGRAFRCEDASRWGRTGSPATSWRNGCCDGSRNADGAPSTRACVYTSVRSARNAARDARAARAVPGFLWRGISVGSGALAAASRAVLRLGHRRGHRLPRWWSCRARAGGRSRPRLGRVGERGRGRAGRSCPGSDAAESGQWAAAARGLAGAFPGRAGGPDGTSPRRRWWLRPRLAGCRAPGAPPPCPVSSWALLPCRSEAAARTRAGRQGRLGARRQGRQGHVGAARGQVLVLRPEKTGVSDDATVDVLDLTPLGEGHGTREFEPEREFDRINLGIVDGGLPQDLLHVARVVLVGDLGHELLDLLLLKVSAAGALDGGREVVGDAAHELREGVHAGLVPDAAVDHGSVGVARAHDHLGEVELDVAREDRVVAEALVEVVERGGDVLGDEEVHDPAAERHLADVAQGFQAFHGLVEVHGEVEKLGVARRDGQLLLQKTDELGDGGAHLALEGPGGLLFHLLLFLLHHLFYFLLRRRWRGRGPASPAAHGQTVDEALDGLPAPATHGLGDGAPVLAGPQHEDAAAHLQVAAGGVSVGQGEGADDASYQLTRRDSAQGPERLEIHGIRKPLNEGFEPVAVARAEPGFLFFGYLVGRRAGDAAGDEVEVGGPETADGGEEHQVLGPGLLDAQTVGHAPGVVLTPGEVLVVVLHEPLHGHLLLARAAVHAREPEPALRLDERQVGDDALGEDGLLDLGEGGLEVVEVDEAVVGSGVDGVGAVGHDGPVDGLVAGSHELVVLEARVGARVEDVVVAGAHEVLVSDEEVRRRLAVERPSLGGGGAGREVLEHEAVVAVDVPGHPGDAGGGGGGARELADAVPDVAQRQEVVHGGRGLAREARAVVDALDIRAKTKAVSGSTPWPGGANGLGCACTPVRISNQAGAAANVVLALPSRPKPANETSRIRRRVVFWPWSLVMKNARKAAARDGSLPSGERIARVALRCAPVRASALGAGRIPRLTWAWLPRRFQDPLASRLLQLRSEPLFFFLVFLPDASRTAADAPPPSTTTAPTAAAATAGASAPAPAAASHYRGGRRERSRRSVPGLGRGRGAGAAGGVVAGAAPARADEKGRSRGLRAQAEPVQRQERRGARGDARLPLPRGAGAAARPGPKAGAEGRGFRGGRADGDQPRARARGRGQPGHGVRADREGGEQLPKILQQPRAHLDRARGGDPGPDAPVGPAGGHRAEPHEQAADGAAVSGGAAQSGQRDVQGGAAEYHRARGPLAPGPGEHFAEHRGAGARAAAVREAGGHQLLGAESGQVLREDLQDPVRAHRQGGEDRRVLHAHDPESADPERRSGGVPQRQDAPRGERQPPARAERPGADAQPAAGPDRGRDRGGELLHGRGPALAAQPPGLGSCRRFPLRGGGGRGGGGRVPGRLMARPYFCMQQQPPPPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVSQRERFHRESNLGSMVALNAFLSTQPANVPRGQEDYTNFISALRLMVAEVPQSEVYQSGPDYFFQTSRQGLQTVNLSQAFKNLQGLWGVQAPVGDRATVSSLLTPNSRLLLLLVAPFTDSGSVSRDSYLGYLLNLYREAIGQAHVDEQTYQEITHVSRALGQEDPGNLEATLNFLLTNRSQKIPPQYALSTEEERILRYVQQSVGLFLMQEGATPSAALDMTARNMEPSMYARNRPFINKLMDYLHRAAAMNSDYFTNAILNPHWLPPPGFYTGEYDMPDPNDGFLWDDVDSSVFSPRPGTNAVWKKEGGDRRPSSALSGRAGAAAAVPEAASPFPSLPFSLNSVRSSELGRLTRPRLLGEEEYLNDSLLRPEREKNFPNNGIESLVDKMSRWKTYAHEHRDEPRASSAGTRRRQRHDRQRGLVWDDEDSADDSSVLDLGGSGGNPFAHLRPRIGRLMESEKIKDGTHQGHGDQRAFFSVVCSSMMRRVYPEGPPPSYESVMQQAVAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVDDDYDGSQDELTYEWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQILYEDLEGGNIPALLDVEAYEKSKEDSTAAATAAVATASTEVRGDNFASAAAAAEAAETESKIVIQPVEKDSKDRSYNVLADKKNTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGVVAPRVLSSRTFKMSILISPSNNTGWGLRAPSKMYGGARQRSTQHPVRVRGHFRAPWGALKGRVRSRTTVDDVIDQVVADARNYTPAAAPVSTVDAVIDSVVADARRYARTKSRRRRIARRHRSTPAMRAARALLRRARRTGRRAMLRAARRAASGSSSAGRTRRRAATAAAAAIASMSRPRRGNVYWVRDAATGVRVPVRTRPPRTRCLRDVDVSQRRGGCPSANTRKRCSRSSRLRSTAPRRRRRKESPANSGSKRTKRRRKMTDWWSLCASSPPGGACSGAGGKNRCCGPAPRWSSRPASVPAPPPSAPTTRCTGTRTSSSRRSSVWASLRTASAAAPRPKRRRCPSRWTTATPRRASRPCSRCYRARRRAGASSARAARICTRPCSWCPSARSWRTCWSTRWTPRCSPRSRCGPSSRWPRAWACRPWTSRSPRSPWKRRPSPSPAPAPWRCRRIPGCQHQLPPALAEDASTARPACCPTTRCILPSSPRRATAARASTAATPAAAAARPPPAAVVAAAAAAPRLPPWCGECIAAGASLPCRARATTRASPFNYRLLLADMALTCRLRVPITGYRGRKPRRRRLTGNGLRRHHHRRRRAISKRLGGGFLPALIPIIAAAIGAIPGIASVAVQASQRHDTKKHGFVIKKKMDRSWSCDVCFMEDINFSSLAPRHGTRPFMGTWSDIGNSQLNGGAFNWSSLWSGLKNFGSTLKTYGNKAWNSSTGQALREKLKEQNFQQKVVDGLASGINGVVDLANQAVQKQINSRLDAVPPAGSVEMPQVEEELPPLDKRGDKRPRPDAEETLLTHTDEPPPYEEAVKLGLPTTRPVAPLATGVLKPSSSQPATLDLPPPRPSTVAKPLPPVAVASRAPRGRPQANWQSTLNSIVGLGVQSVKRRRCYKTLRLTCLSVCICMSADQKEECEEARRRVARWPPHRCCPSGRTCTSPDRTLRSTVRVWCSSPAPQTPTSVWGTSLGTPRWRPRTMPPTAASGRCASCPWTARTTPTRTKCATRWPWATTACWTWPAPTLTSAACWTGALASNPTLAPPTTALPRELPIPASGSKQKQAMGELWKHTHMVWPQWAERILQKMVFKLELTLQRIRINQFMPTKHFNQNRKEKKIGKKLKTFMAVELLKKTQTNLAMAPMLDPPMKKEVKLNLKLEMMEFQPKNSTTWLSLILPVAPTVKTSIKQTLSCIPKTRIWKLQTRMWYTNQARMMQVLKLTWFSSLCPTDPTTLGSGTTLSVLCTTTALAIWVCLLVRPPSMLWLICKTETPSCPTSSCLTLWVTEPGISVCGTRRWTVMTPMCASSKTMVWRMNCQTIASPWTALALTPHTKVKKMVKMVMLRVNGKMTILLQLEINYVKVTFSPWRLISRLTCGEVSSTRTWPCTCPTPTSTRRPTSRCRPTPTPTITMAEHLPRWTPTSTSGRAGRWTPWTTSTPSTTTATRACATAPCSWATGATCPSTSRCPKSFSPSRASCSCPGPTPTSGTSARTSTSCRAPATTCARTGPPSPSPASTSTPPSSPWRTTPPPRSRPCCATTPTTSPSTTTSRRPTCSTPSRPTPPTCPSPSPRATGPPSADGPSRARPARRPRSAPGSTPTSSTRAPSPTTAPSTSTTPSRRSPSPSTPPSAGPATTASRPTSSKSSAPSTERDTTWPSATPRTGSWSRCWPTTTSATRASTCPRATRTACTPSSATSSPAARSWTRSTTRTTRPSPWPTSTTTRASSATSRPPCARASPTPPTTPTRSSARAPSPASPRKSSSATGSCGASPSPATSCPWARSPTSARTCSTPTPPTRTISKSTPWMSPPFSMLSSKSSTSSECTSPTAASSKPSTCARPSRPATPPPKPLLLLARRRAPASRSSGPSSATWAAGPASWAPSTSASLDSWPRTSWPAPSTRPAARPGASTGWPSPGTRAPTHATSSTPSGSRTSASSRSTSSSTRACCVAAPWPPRTAASPWKSPPRPCRVRARPPAGSSAACSCTPSCTGPTAPWTRTPPTYRGCPTACSSRPRWNPPCAATRKRSTASSMPTPPTFAPTARASRRPPPSTAIKTCKKPVCVCECFIHNKQHMFMPPSLRLLYLEIEGVLPALGMARGQGYVAELVLGQPLELGDQQLGHGEVGERVAPQLARELQGAQQVGRGDLEIAVGTRVLRARVAVHGVAALEHHQGRVLHACQHRRVGDALHVQILGVGHPEGGHLAGLPPHAGHAAGLVVAIAVQGDQHHLGLLGAHARVHGLHESLQLAEGLLRLAALGEEDPAGLARELVGGAAGVVHAAARVVVGQLHHAAPPAVLGDLGPVGVLLQRALPVLARHIHLDSVLLLDHHGPVQAPQLALGFGAAVQPQRAAGALPVLVGDLGVRVHEALQEAAHHRGQGLVAGEGQRDAAVLLVHIQVADAAVHLALLGHQLEGGLQVALHAVPVHQQRHHFHALLPGRNDRQAQGVLHRHCHLSRRRRGQGVVLVQGLKHSLAVLLDDAHGGKAEAHGRQLLLGLPFVLAVLADVLQRHMLGLAGFLFGRQRRRRCAGRARVLVHHDYFFFLAVVRDHAAVGMPLLGQRRRRRALAVRRAAGRAPSAFGGALLAALLLTSSAAGHCVLLGSNNKHGDSAIVANIAICPRRHRRREPAAEKLNRPAAQPHLRRRGPRHARDGGIHRDPGLRDARGARGGAGSALFSPGREPPRAARAGSRERAEPGWARAWRLPERGRGRAHQASGPPMHHRQGRAARPRRGAPQRGGAQPRLRAQPLLAARAPQAPAQRHLAQPAPQLLPGLRGARGPGHLPPLFQEPKDPRLLPRQPHPRRRPAQPGPRRPPTYHLLGRGSQDLRGSGQRRDSGRERSARKRRGAAPQRPGGVGRRQRAPGGPQAHGRADPLRLPGAQPAPQGHERRHGPGAHQARLAPLGGGDAGPREFGRGQARGQRRAAGALAGSEHPPEPGRAAQAHDGRGPGDRGAGVSAPLLCRRGDPAQGRGEPALPLQARVRAPGLQDLQRGADQPGLLHGHPAREPPGAKRAAHHPARGGPPRLHPRLRLPVPLPHLADGHGRVAAVPGGAEPERALQAPAEEPQGPVDRVRRAYHRLGPGRPHLPRAPAADAAQRAARLYEPKHVAKLSLFHPRTLRDPARHLLRAALGLRAADLPRVPPAALEPLLLAAPGQLPGLPLGRDRGRQRRGSAGVPLPLQPLHAAPLPGLQPPAAERDPDHRHLRVARPRRRRGQGGSETHPGAVDLGLLAQVRARGLPSLRDQVLRGPIPAAQGRAVGLRHHPGGHPGPIASHPEIPPRISAEKGPRGLLGPPDRRGAQPQLPPGCPEEAARSKWSCRRRRIWRKTGRAVRQRRRRWKTGTALRQRRTACKTVWRRKTRWRRQRKKQPPPDRRPRRRKQAARIPSPLRVGVAAAGPTVGGTRPGASRTPPPRPVRRSGRDTSPGGGTKTPSSPACKPAGATSPSPGATCSSTAGTSPATSCITTVTSTAPTTVSKKRQKPSSSRKPAAAAARKSTAAAGGLRIAANEPAQTRELRNRIFPTLYAIFQQSRGQEQELKVKNRSLRSLTRSCLYHKSEDQLQRTLEDAEALFNKYCALTLKEPAPAHTRKKAGITSPPAPFARPSAKRFPRLTCGATSPRWAWPPAPPRTTPPATGSVPGPRSHGMTSAPTETRYSNSQRSPPRPAITLIRVIGPPPWCTRKFPSPRPYYFRETPRPKSSLTQVSSWPAAPPCVVTAPLRVSGWSEAEAHSSTTRWALRWVCDLTESSNSPDRGDLPSRLVRPSLWRVRPRSPARAASALSSSWRSSLPRSTSTPSPAPPATTRTSSSRTSTPSASRWTATIECPMVAQLTLGFDTWTTAAASAASLGISPSLPTLSCPRSTLRAQPTECGSSSKGASTPTCFGSSASDRSWSSANKDRPFLLCTASATTPACMKVFVVCCVLSIIKAEISDYSGLDCGVPAINRSLFFTGNETELQLQCKPHKKYLTWLFQGSPIAVVNHCDNDGVLLSGPANLTFSTRRSKLQLFQPFLPGTYQCVSGPCHHTFHLIPNTTAPLPATNNQTTHQRHRRDLSSESNTTTGGELRGRPTSGIYYGPWEVVGLIANKKNNHLINKDTIILMIVQKRITYLKSDTRSLSMFSANTTSLPSSQLWYCRPRRAANFLHTLKGMSNSSCPSIFILSSIRCPKSASGWMMTSTPSTPTMQTTHRPCPSSTPPSSLQMDSKRSPWGCCPCDWLTPSPPRTGKSPSSWERGWTSTRRENSSPTRPPRPPPLSVFQTTPFPLKLLPLSTTTMELASMSPHHQYFPHLTLAVLETVFRLQISCLYNLILLHSAQIASQKQTKGYILTPVETEDLRLIAKEDFLTVMLLQHILEMATMDLMIVMEKQDPLPKLEQDILMLTKQLSNAQVVLTPLVPQLETNRMTSHFGLPLTQALIVNYFQTEMPNLLSVLQNAVVKYALWQWRLLLDQHIQLMTQSKAPFSLDLIPMVYSCQTHQWVITGTLGRDRPLKVPIQMLWDSCQIVHIQKPKVKHLKIASVRYILEKLLCQHPLSMALMKKTQPQLAPTLLLHGSGLETIRTKILPLLPTHSLFPTSPRNNPTQQANPFSHHLCLYGNSETEKSSSVLLNQQFYRTRAVIFPPPSQDMEYTTLSPRTALNIMPLVMDMLLVSTFHTVSERASLGSVREMKPSGHSRICTSQLNSGLSSVVGITVIWKKQKSGGGNHSPRTGSAGGVASGPAAVAAAAAPSSCCSGGSGPGTPSACPRPSASVVWCGGRSSACESRSGHCSTCNTGPPGCSTVHSSTRSSRNSSREGCYPRGRRTRSSGKSSGAPSRRRCPCTSPWACGGSPPPGTTSPSGTCSPGSCGTTGPAPPRPPCSEETPDPGNDNGGPTARTRGSSGSTSLCWHSTGICSCISSALSAPRGSKPYPRARGTLAGQRTPQNRAILAHNLHCAWTGYRNQAAPGDPPPEKRGSRSPHSVVRGPADTGDGGTRLIVFSTVSCSCFRTFSYLLQNLVRALHTDRRRRSRRLERSVLKLNSHSLRPCSRSRASGVMKIPSCLIALITSTTVEWARPSQMMQFCWVSVTAGEGRTGRTMINFSKRSRSTSKRSRRWHLSPPLCWWKITARSKVIRFSRCSTVASSKASTRTSRNKTIAKAGGFSNSSTIMLHSCTIPRFSFFQPMIRTSSGKSKPAMIKSSRRAPSTGILKHTLIIPRYSAPGSPAADQAEYQNLCRDPAPPSAITVSTLSYRLRNFPDPQEEKGKPHYRTEVPPSEHCQMDNKHAGTRYLPDNWTENRVSNFENQQKKNLPGARLGPREQRWSKCKGCVPAWLVSSVKKQKIKHTMLAWRTGGIVLSSTRQATGSPARPSKLSLLKTITERRSRWPAMIREEAYTPGTLESVSEKKRPRKQGTTTLTLKSSKAMPCGSTKFSGAKMLLPSCTGSEAPDPSRYTYKASASIAYRAAAAAAHNRRKSQRKDALTCPPALCSIYSPRSTLTRPKSKNTRQIITHAQHTPRNRHTQKNTRTSSNGQTAVISGFPRYVIKTRLSNSVDRKHHPPRPRSPLPQPITFLPPQIQTAHLHINAHQKFEVYY

SEQ ID NO: 11 - protein, 10925 aa, Artificial Sequence
  Artificially Synthesized
  misc_feature (1794)..(1794): Xaa can be any naturally occurring amino acid
HHQYTSNFWCALICKAVIWGGRKVIGRETGDRGRGGRFDDVAVRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLRLEYLIRLTIGLRLEFDATMRVMGILRSYQQWWIWGILGFWMLMICNVWGNLWVTVYYGVPVWKEAKTTLFCASDAKAHKEEVHNIWATHACVPTDPNPQEIVLKNVTENFNMWKNDMVDQMHEDIISLWDQSLKPCVKLTPLCVTLNCSDVKIKGTNATYNNATYNNNNTISDMKNCSFNTTTEITDKKKKEYALFYKLDVVALDGKETNSTNSSEYRLINCNTSAVTQACPKVSFDPIPIHYCAPAGYAILKCNNKTFNGTGPCNNVSTVQCTHGIKPVVSTQLLLNGSLAEEEVVIRFENLTNNAKIIIVHLNESVEINCTRPSNNTRKSVRIGPGQTFFATGDIIGDIRQAHCNISRKKWNTTLQRVKEKLKEKFPNKTIQFAPSSGGDLEITTHSFNCRGEFFYCYTSDLFNSTYMSNNTGGANITLQCRIKQIIRMWQGVGQAMYAPPIAGNITCKSNITGLLLTRDGGKEKNDTETFRPGGGDMRDNWRSELYKYKVVEIKPLGIAPDKAKLTVQARQLLSGIVQQQSNLLRAIEAQQHMLQLTVWGIKQLQTRVLAIERYLKDQQLLGIWGCSGKLICTTAVPWNASWSNKSYEEIWGNMTWMQWDREINNYTNTIYSLLEESQNQQEKNEKDLLALDSWESLWSWFNITNWLWGTSRVDPGGQTADQPRLCLLVASHLLFAPPPCLPPWKVPLPLSFPNKMRKLHRIVVGVILFWGVGWGRTARGRIGKTIAGMLGMRWALWLLRRKEPADLQIIHLCRVRRKRNGIMGIMGLHIGQISICWPPCMPRTPARHGPSSSTTSPDAMCTWGPAEACSCPTSATCNLRCCWSPMPCPEARGCLTMWSCGKFDMMNPRPGAGPANAEASTPGFSPCVWRRRTCDPIIWCCPATGRSSAPAGKNLTRVSSVWGRWRACMRGRMTKICVFLCVAAAAEAPPLREGYSALIRGVSPPGRECVRMWDPRWTAGPCSPRTLQPPTRPAPRPWTQLPPQLLLPPPAPCAEWPWAPATTALWWPTRLPPIIPPATRRSCCCWPSSRPPSAWASPSRWLSCRRRRGPRLPRKPNKKINKTETVVDFNTESIFIFFARGRPWTTGLDHAPGGFFPGPGRGGLGCGTWAARPGGGGSSIAGPRARGWCCKSPSHSRGAGRGAARCPGGDWPRAAPWCRCRTCAGRDACGGRDASWPGSDWRCSRPDPAGGSCCAGPPARCIRRTWGICHATWKGRRERIWRRPCDRPGFPCTHPWRWARGRRPGQRRFGGRTHRSCGPGARHRPFIWGGGCPTGGRRCPRSRGRSCPRRSASPRPARRGGSCPPAGRKKRFPGRGRAGPKAGSGAAGTCRSRWGRRPRPAAGGSGRDSCRPRGGGGPPRSSSRAHACSRARVPPGGARPPARGALAARRSFSAAXRRPWAFWRGSVARVPDGPRARCALGHLDPADLLVSRVGATAGVGHQAMGVQRGQGPVLPGSQGPRQRGLRHGEGVRAGLGACEGALQAHPAGREPLPVGALRVGQVAIEHEFVVERLGRVALGAELTFGSVSADGTEEGLEGVELGGEEDGLGGVGVRAAAGADGLALHEPGEVGPVGVKNEVSSVLFDAFLTSGLHELVSPLGDKEAVRVPVDRLYGPVLERGAAVLVVEEPRPLRDEGPGPGQHEGGHVGGVAVVVHQRVHLLQGMQAHVPLVHIQEGDWLVSVGHVTGGPGRGGIKGGGPLLVLTVFRIAVQERQLLGVFPLEGWHNLGTQVVSFKRGGFDIDGAVGDAFHEPLVHLVRKDDLFVVELGGEGAVEGVGEELGDGAHGLVLFLVGALLGGDVELHVLARHALPFGEDGGELVGHDSDPPAAVVQGDEVHAGGHLAAQGLVGPAEAPALARAEGGQRVQHELVGGVGVHGEDAGQKLGVEVADAGVQIVQRRLPVAHGQRALVGAEGRAPGHGVRERGGVHAADVVDVEGLLEDADVGGVAAPPADAGAHVVVQLVRGREEPRAEVGALRLFGAVDDLAEDGVGVGGDGGPLEDVEVGVGQADRVPDEVGVGVLQLGDELGGDEDVQGAVVEGLLDDVVLELALLLPQLAVEKELFAVLPVLFEGEPVLIGTVRAHHVELVDGLVGAAALLHGEGVSLCGLAQGGVGEGEGVAHHDLEELVLEVEVVAAALLPELEVRALLVGGVGQSESNIVEEDLARAGHEVASDAERLGHLGPVVDDLGGEDDLVEAVDVVPDDVEFHESRAALNVGQLLELVVGELGGVAEPVLLEGPVGDVGVGAEEGSPEIHGQGGLQAVPVLTELLAHGHFFGGDAVEGAGVAVPAVPLELEGEVVGELDERRVPGEFHDQHEGDELLAEGPHPGVGFHIVGEEEPFGARMRADGEELDLLPPVGGMAVDVMEVEMPTARRALVLVFIQASAVLATLHGMHVLHELYLGSFDEEFQWAVERWRLHLVLYYVLAIGVAIVCLDGGHADEPAREAGPDFGSDGSESEDEGAQAGAVQGPETLRSQVSGQRRRAVDLQELFQGAREVQMVLDLHGAVGGDVHGLQGPVPLGRHHRAPFLLGRCFHAGQKRRRGRAPGGRGGSGPGGRGGRGTSAPRAGRFWYCARRRLAATTRRLTSWIRLWVKATGPVSLNLKESSTESISVSLTAACRRISCTSPELSWAISVMNCSISSSRSPRPARSTVAARSLEMRPMSCEKAFMPASFQTRLTTAPSGSRARMTTWARLSSTWRVKTALQRRWRLSVVAMCSVTKKYMIQRRSGISLTSPRASKRSMASKSTAKLKNWELRAETVNSSSRRRMSSAMVARTSRSKAPGGSSSSISSSSTNISSTSSSGGGGGGGALRRRRRTGRRSMKRSMVSPRRRRMVSVTARPSSRGRSVKTPPRISRWPPGGSPLGRERALTMHLINWPVGTPRKDLSVSRSTGSENRTKASSQSQSQGRLSPVSCSSGISGGGRAMLLVMKLKAVLRRRMVARSTRSLGPACWMRRRSAMPQAWSHLARSLSCMSRSTGTSSSPARPCMRVSPNPRWGWTSARSATTRSARMACCIWVRVVWKSSKSTKRWAPVLMVEQLAMTDQLTVWWPGRTSSWYLRREARVSKMSLQVRTRYWYPTRKCGGGWRSGHRSVAGAPGARSSSMRRWPMYLDIQVMPAAVVEARGNSRTRFQMLRSGRKFMVAAVWPVRRAQSWMLTYGQKRKRSAARLRGLEAKRTGWAARVPRFESRIRLEPQLTWYWHSRLDPSLLTKPPGYGGGSFFGLGRWSKTSKRGKRPPAMARCRSLEKESPGLRCGVPRFEPQRSAPAGFRGRGRGCPVVSKTPPADFSSYGASPSFSCVFARCIPYCGRCAPTLHLNRPYRRSSSNSRRFCPRPSSSQPLPRRPPAEPAFSMTWPWKRARGWRGWGRRRRSGTRACRKGTLARPTCPSRTCSETGAARSPRRCAPPASTRGGSCGAAWTESGCGTRISRRTSRGSAPRARTWPRPTWSRRTSRPRRRATSKNPSTTTCARSRARRPWACTCGTCWRPSCRTPRASRRRSCFWWCSTVGTTRRSGRRCISPSPRAAGSWTWTFCRASWCRSAGCRCPRSWRLSTSRCAWASTTLGRSTRPRTCPTRRRSTGFTCAPKCPATIWGCTATTGCTARAPAAGASATRSCTACSGPPGPGPRGRATLTWARTCAGSPAAGPWKLPAVPPTWRRWTMRRRRASTWKTDGATVFLLDAATATASSRDAGGAAEPAVRHLLGRLDPGHATHHGADDPQSRSLTAASGQPALGHPGGRGALALEPHAREGAGHRERAGGEQGHPRRRGRAGVQRAAGARGPLQQHQRADEPGPHGDRRARGGVAARAVPPRVEPGLHGGAERLPEHAARQRAPGPGGLHQLHQRAAADGGRGAPERGVPVGAGLLLPDQSPGLADREPEPGFQELAGTVGRAGPGRGPRDGVEPADAELAPAAAAGGALHGQRQREPRLVPGLPAPVPRGHRAGARGRADLPGDHPREPRAGPGGPGQPGGHPELPADQPVAEDPAPVRAEHRGGAHPALRAAERGAVPDAGGGHAQRRARHDRAQHGAQHVRSQPPVHQADGLLASGGRHELGLLYQRHLEPALAPAARVLHGRVRHARPQRRVPVGRRGQQRVLAAPRHHRVEERGRGPAAVLGAVRSRGCCRGGAGRQPLPEPALFAEQRAQQRAGSADAAAPAGRGGVPERLLVEARAREELPQRDREPGGQDEPLEDVRARAQGRAPSQQRRHPTPATRQAAGSGVGRGFRRRQQRVGLGWEWWWPVRSLAPPYRAPDVRIKNKKRYSPRPWRPACVLLCCLYDEARVPGGSSSLVRERDAAGGGGGDAAPAGGALRAPAVPGAYGGAEQHSLLGAGTLVRYHPVVPGGQQVGGHRLAELPERPQQLPDHRGAEQRFHPHGGQHPDHQLRALAVGRPAENHHAHQHAQRERVHVQQQVQGAGDGLAQDPQWGRGGELWSGRADLRVGGVAARGQLLGDHDHRSDEQRHHRQLLGGGASERGAGERHRREVRHAQLPAGLGPRDRAGDAGRVHQRGLPPRHRPAARLRRGLHREPPQQPAGHPQAAALPGGLPDPVRGPGGGQHPRALGCRSLEKQGGGRRSGDRSRGHRLYRGAGRFCRRGSGRGGNRKDSHPAGGEGQQGQELQRARGQEKHRLPQLVPGLQLRRPREGRALLDAAHHLGRHLRRGASLLVAARHDARPGHLPLHASSQLPGGGRRAPARLLQELLQRAGRLLAAAARLHLAHARLQPLPREPDPRPPARAHHYHRQKRSCSHRSRDPAAAQQYPGSPARDRHRQTPHLPLRLQGPGRSRAARPLEPHLLKNVHSHLAQHRLGPARAQQDVRRRSPTLHATPRARARALPRSLGRPQGPRALAHHRRRRDRPGGGRRAQLHARRRARLHRGRRHRQRGGRCAPVRPRQEPAAAHRPAAPEHPRHARGASLAAQGQAHGTQGHAQGGQTRGLRQQQRRQDPQTRGHGGGGGHRQHVPPAARQRVLGARRRHRCARARAHPPPSHLKMLTSRCCVPAARRMSKRKYKEEMLQVIAPEIYGPAVKEERKPRKLKRVKKDKKEEEDVDGLVEFVREFAPRRRVQWRGRKVKPVLRPGTTVVFTPGERSGSASKRSYDEVYGDEDILEQAVERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTTRRRRKYGAASLLMPNYALHPSIIPTPGYRGTRFYRGYTSSRRKTTTRRRRRRTRRSSTATSAAALVRRVYRSGREPLTLPRARYHPSIAILCRRLLLADMALTCRLRVPITGYRGRKPRRRRLTGNGLRRHHHRRRRAISKRLGGGFLPALIPIIAAAIGAIPGIASVAVQASQRHDTAWKICNKKMDRSWSCDVCFMEDINFSSLAPRHGTRPFMGTWSDIGNSQLNGGAFNWSSLWSGLKNFGSTLKTYGNKAWNSSTGQALREKLKEQNFQQKVVDGLASGINGVVDLANQAVQKQINSRLDAVPPAGSVEMPQVEEELPPLDKRGDKRPRPDAEETLLTHTDEPPPYEEAVKLGLPTTRPVAPLATGVLKPSSSSQPATLDLPPPASRPSTVAKPLPPVAVASRAPRGRPQANWQSTLNSIVGLGVQSVKRRRCYKTLRLTCLSVCICMSADQKEEEARRRVARWPPHRCCPSGRTCTSPDRTLRSTVRVWCSSPAPQTPTSVWGTSLGTPRWRPRTMPPTAASGRCASCPWTARTTPTRTKCATRWPWATTACWTWPAPTLTSAACWIGGPASNPTPAPPTTAWLPRERPTLASGHIKLVILIQKKPIHMEMHLCKALALQRMVFNLELTAMVRQSMQTKLINQSLKWVMLNGMTSLVLMKNMEAELLSLTPKSLAMVLLPSLPIKKEARQMKPKQAVPKNMTLTWHSSIIEVQLPPAPQKLFCILRMWIWKLQIPILYTRQVQMTVALLSIWVSSPCPTDPTTLASETTLSVCTTTALAIWVYWLDRPPSMLWWTCRTETPNCPTSSCLTLWVTEPGISVCGIRRWTVMTPMCALLKITVWRMNFLTIASPWMLWVELILTRELRPMVIIKPPGPKMILLMMLMNWARAILSPWRSTSRPTCGGTSSTRTWRCTCPTPTSTRRPTSRCPPTPTPTITTAAWWRPRWWTPTSTSGRAGRWTPWTTSTPSTTTATRACDTAPCSWATGATCPSTSRCPKSFSPSRASCSCPGPTPTSGTSARTSTSCRAPSATTCARTGPPSPSPASTSTPPSSPWRTTPPPRSRPCCATTPTTSPSTTTSRRPTCSTPSRPTPPTCPSPSPRATGPPSAAGPSRASRPARRPRSAPGSTPTSSTRAPSPTSTAPSTSTTPSRRSPSPSTPPSAGPATTASRPTSSKSSAPSTERGTTWPSATPRTGSWSRCWPTTTSATRASTCPRATRTACTPSSATSSPAARSWTRSTTRTTRPSPWPTSTTTRASSATSRPPCARASPTPPTTPTRSSARAPSPASPRKSSSATGSCGASPSPATSCPWARSPTSARTCSTPTPPTRTISKSTPWMSPPFSMLSSKSSTSSECTSPTAASSRPSTCARPSRPATPPPKPLASCKMTACAGSGEQELRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDMSGVCMMLYSSTAHVYATFSEALTLFRNRRGSAGSRHGPRAGIRCGTGTWAATTRGSAASARGGRGTSRSTACAVAGRPAGRARRSNRSWDPRSARESYGTRGCSTGTPSGPGASRSPAPSRRCPPRPDPRRWPSRRGSSCRSAAPCWARSRACGCNRSAGGSASSGPARSSCPGTWPSKPPAGGRPAAPCRPRRRPRRTCRTGWWRSQRRARSSARRCWPAAPRCAPSGSGSWPGRGSPSARAARSRSPHPSRSCAPSGSSRSRAGTAACPRPRCTRAATARSRCSPSSCGRSGSASARSPAGSGPSSWSGSCCWRSAECRGAPRSHTGGRYGGTPRPARASAGRRTSGRSPRGTGPSAASSLPCPSPRPKRSAGSGGSSPLSSSPPPKSGGRSRPGSQTLACRPSRCARGESSPRPPAPPRPAFRPRCPGCLAKAHAWSCGVSFWAAEAAAETCWASASSRSPRLFLLLGRRPRPRGGRHASSGAEAEATGSRGSAGGWQSPFRVRGCAPGGAALTDFLRGRPLCSPREQAWRLSHRRQHRHLPPPPPTRTSSSRMKAPPRRPAPPPTPQPQTCKRWRNPSRLTWATRPRSTRRSWQRAFQPRKRTTKSSQSRKQRASRTRLGSSMATTAGQRTCSSSIWPANASSSRTRCSTAPRCPSAWRSSAAPTSATSSRRACPPSASPTAPASPTRASTSTRSSRCPRPWPPTTSFSRTKGSPSPAAPTAPAPTPCSTWAPAPAYLISPPWKRFPRSSRVWAATRLGPRTLCKEAERSMSTTAPWWSWKATTRAWRSSSARSSPTSPTRRSTCPPRSAPSWTRCSSSAPRPSRRRRCRTPRARTRASPWSATSSWRAGWERVAPPRAWKSGASSWPWSWPWSWSVCAASSPTRRPCARSRRTCTTSSDTGSCARPARSPTWSPTWSPTWASCTRTAWGRTCCTPPCAGRPAATTSATASTCTSATPGRRAWACGSSAWRSRTKSSASSCRRTSRPCGPGSTSAPPPRTWPTSSSPSACGRCATGCPTLAKACCKTFALSSSNAPGSCPPPAPRCPRTSCRPSASAPRRSGATATCCAWPTTWPTTRTSRTSAARACSSATAAATSARRTAPWPATPSCARPRSSAPSSCKAPARARGVNSPRGCGPRPTCASSCPRTTIPSRSGSTRTNPSRPRPSCRPASSPRGPSWPNCKPSRNPAKNFCKRATGSTWTPRPERSSTPASPRMPRGSSKKLKVELPPPPEDLEEDWESSQAEEEEMEDWDSTQAEEDSLQDSLEEEDEVEEAEEEAAAARPSSSAEEEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQQQQKTSGSSKIHSGGRWTEDRGERAGADPGAEEPDLSHPLCHLPAESGARAGTESQEPFSALAHPQLSVSQERRPTSAHSRGRRGSLQQVLRAHSRVARARPHTEKGGNYVTTCALRPTIIMSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYDMSHGGAADLARLRHLDHCRRFRCFARDLAEFAYFELPEEHPQGPAHGVRIVVEGGLDSHLLRIFSQRPILAEREQGQTLLTLYCICNHPGLHESLCCLLCTEYNKSDQRLLRTSVCSCYQPVPVLHRERDRAPAPVAPQEVPHLAVPGLSDRRCQPLRQRRSPAERPCQPYFFHPQKQAPALPTLPPRDLSVRLGTLPSHLPPDPEYHSVAPRYQPNYPPTPPSRPRTCTELEKYATIHAHIRLGRATATHAPRYLLQSNRRRLTHWPTTTSTTFSWTWTAAPRSSDSPNFAFASSRREPSRSCRTAPSTSARKASSAWNRPRSPTRSPRPTIASPTSSCSSARSSPAWSESTPSSSPSSRAIPRGASTAPATPPTASTLSRPSAASATSSPTNHPLIQNKYHIDDDLNKKSFDLKRYNHIDDLSFKKRITYLKSDTRSLSMFSANTTSLPSSQLWYCRPRRAANFLHTLKGMSNSSCPSIFILSSIRCPKSASGWMMTSTPSTPTMQTTHRPCPSSTPPSSLQMDSKRSPWGCCPCDWLTPSPPRTGKSPSSWERGWTSTPRENSSPTRPPRPPPLSVFPTTPFPLTWIPLFIPKMENYPYKFLHRTYNQPFTHLLMDQVDVVALLLQYSWPLHSLLMKKEILKLTPVVHQLMQVDLVSTAKEGSLSLPQEMQLKATAGLKVDLKVMALQTLAEDWNLEPLVQRLMSQMHTQFKLNWVLALPLTVQAPLLLGTKRMINLHYGPQPTPRQIAKYTLKKMPNSHFAQSVEVKFWVLLYWQIMEVSTQSQTQALHSSPSSLMQVEFCAAPHTKNIGTSEREMLHLLSPILMLVLCLTRPILKTHLQLQKAILSVKFISMGMRPNHCLLLLMKLRMQLAPTVSLFNGNGIVLSTQVKHLLPAPSPSPTSPKNEHCIPPCMPTLPTPLCLWKKLSTKNKVQVFYFNSFTGFEQLFFLHPPRTWNTPPSPPAQPTSECHWWTCFWSPRSTQFQSEPVSGRSGRNPPGTPASAPHSSTAEDCPRWSGSRLSGRSRRAAVGIIVRERDRPVVSHQAPQQSLPPPLRQAAAQGVRVQGLPQHDAHGPQHQSSGAAGAAAHADLAQVAAVRATQDHQVVQQSIVQHAPAETHRGKDATHVAVVPDPQVNQVALPPEHAAHVHDLLGHVAVHHLPVPHHPLVEHAAPDDPAEPQGQHRPARHAAKRPRVPAMAMEDPPLVPVDHLGAEQVYVGTAQAYAHASLQHSQLLGGQNHIPGHGELLQDSEPRRTGQSSHITYIVHGQGIAIRQHRVILHQRSAGLGLLTAWGGRPIRVMAGRGSCSRPCHDAVAFGHFRTCCSRTWSGRCTPIAGGGPGAWNARCNCKTATLSDRAADLGPQERSHHALSHRPPWNGPDPARCNFVGFRRRGREEQEEPLTFNPNGLGALQNEGRGDGTSRPRCVGGKQPGQRYGSRDVPRWLPAKPPRAHPETRQRKREGSLIPQSSCYTPAPSPDNFHFSSLEFELVPEVNPSQPRARAERPPPAFLSTPSFQDILLLVHLQQIDKRNIKISAAIPKLLPQQLVLFHILSEIFSHRTTRNKIRASHSTDKPKSSPVSIAKCKTAISMLARPGDIFQITGQKITQAIFKKINKRKILQVHVSLGNNDEVNASGAFQHGLADLKTKNKTLNHASLANRWVNRSLQHQAGHGVSGATLVKIVAMIENHHRETFPVAGVNDSTRIHPRNIGVREKKAPEEAIRHYNAQSQVQQSDAMRMKHKILRCVQNVITPLLHRQRSPRSLQIHIQSLSVHSLPSSSTQQAQESEKGALTCPPALCSIYSPDLHRKGQSLKIPAKSHTPSTRPETGDTLKKIRALPQTPKLPSFPGSHATSSEFDFQIPSTVKNVTRPAPNGRPSLGQSPSSLPKFKQLICILTRTKSLRYIIDD

SEQ ID NO: 12 - protein, 10908 aa, Artificial Sequence
  Artificially Synthesized
HHQYTSNFWCALICKAVIWGGRKVIGRETGDRGRGGRFDDVAVRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSYSITGSLVHSPYMEFRVTLTVNGPPGPPNDPRPLTSIMTYVPIVTPIGTFHRQWVEYLRTAHLAVHQVYHMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLSCRSWSGTGQVSIKVTRQVGDQKLGLSRQRRLLRFAPIGLTDIHFAFLSTGVHSQFNYSSGSTYDSLASATMGARASVLSGGELDRWEKIRLRPGGKKKYKLKHIVWASRELERFAVNPGLLETSEGCRQILGQLQPSLQTGSEELRSLYNTVATLYCVHQRIEVKDTKEALEKIEEEQNKSKKKAQQAAADTGNSSQVSQNYPIVQNLQGQMVHQAISPRTLNAWVKVVEEKAFSPEVIPMFSALSEGATPQDLNTMLNTVGGHQAAMQMLKETINEEAAEWDRLHPVHAGPIAPGQMREPRGSDIAGTTSTLQEQIGWMTNNPPIPVGEIYKRWIILGLNKIVRMYSPTSILDIRQGPKEPFRDYVDRFYKTLRAEQASQEVKNWMTETLLVQNANPDCKTILKALGPAATLEEMMTACQGVGGPGHKARVLAEAMSQVTNSATIMMQRGNFRNQRKTVKCFNCGKEGHIAKNCRAPRKKGCWKCGKEGHQMKDCTERQANFLGKIWPSHKGRPGNFLQSRPEPTAPPEESFRFGEETTTPSQKQEPIDKELYPLASLRSLFGNDPSSQSSVTGPLESTRAAKPLISLDCAFLPAICCLPLPRAFLDPGRCHSHCPFLIKGNCIALSEVSFYSGGWGGAGQQGGGLGRQQACWGCGGLYGFGGKNQQICRSEFIYVGCGERGNEMALWVLWVCINESARYAGHRACDLAPPQDMARVRAQRHDPMQCAPGVPPRHVHALPVQHAICEGAAGARCHVQSEPDGGVHECGAVENSEIIQDQVPGLRMRRQARQASARVCGGDGGPATRSFGVVLQRDGVRLQRGRILEVVFGGGGGLVGAELKSVFFCVLQQHERKRLLGRGIQPLSDGASPLLGGSASECDGIHGGRPARAARELFNPDLRDPELLVRGRSCRRSCCFRRQRRARNGPGRRLLQLSGGQLDFHQSRQPERGEAAAADGPARGPDPAPGRADPAGGSAAGGDAGRGCHGENQIKNESINKRRRLLILTQSLESLFDFSRAVGPGPPVSIIEHPVDFFQDPVEVGLDVEVHGHEPVPGVEVAPLQGLVLGGGVVNHPVIAGAQGVVLHDVLEEETDGHGQPLGVGVDEPVELGGMHAGGDEMHLGLDLEIGDVPAQIPPGVHVVQDHQHGVSGALGEFVMQLGREGVKEFGDALVTAQVFHALIHDDGDGPVGGGLGKDVSGVGHIVVVVLGELVIGHFNEFGAEGARLGDEGALDPGGVVALADLHLPGLELGGGDHVHLRGDEKNGFRGGGDELGRKQVPEQLGLAAAGGAVDDPDDRLQVVVEGETAAVLAEEGGHLVHHLAHMHVLAHEFRQEALAPQREELLQRGEVFQRLEPVGHGHFGEGLLQEFQTVPELGDVLGISIQQTSSFRGLGRLREGTRRWASSEARVRSFQGRRVRVSVVSVTVKGCAPGWALARVRFRLIRLVENRSRSAPCASARQLSMSSLSASAAWPLARSLPLEVCPQTGQRRDLRASLGARKTDSGAASAPQLAQTVSHSTSQVRSGRLGSKTRFPPCFLMRFLPLVSMSSCPRWVTKRLSVSPTDFMGRSSSGVPRSSSRNPAHSETKARVQASTKEATWEGRSLSTSGSTFSRVCKHMSPSSTSRKVIGLVATPGVPAGGVKGAGPCSSSLSSGSLSRSASCWGRYSLSKAGITSALRLSVSRNEEDLILTVPLETPFMSPSSIWSEKTIFLLSSLVAKEPRALERSLAMERMVWFFSLSARSLAAMLSCTYSRATHFHSGKTVVSSSGTILTRQPRLCRVMRSTLVATSPRRGSLVQQRRPPLREQKGGSGSSMSSSGGSASTVKMPGRSSGSKLMQVSRSSSAACQSRTASARSGLRGVPQGMGCVSAEAYMPQMSTRGSSRTPMVGQRPPRMLARTSYSSCEGARSPVPRLERCGFSARTIWRKMAWELEEMVGLWKMLKWAWGRPTESLMKWAESCSLATSSAVTRTSRAQSRVSWMMSYLSWPFCFHSSRLRRNSSRSFQYSSRGNPSSAREPTMNWLTALAQQPFSTGRAACAALRREVWVRAKVSRTMTLRNWCLKSRSSQPPCSQSWKSVRFLAGLGKAKVTSLKRILPARGMKLRVMRKGWGTSARLLMTWAARTISSKPLMLCPTMSSTNRGRPLTWGSFLSSSVSSAGSLSPCCSRAQSATWGLALRKEVQRSTARAVCKRSRYRNCWPTAIFSGVTQKVRGSPCQRSHLSWRARSWASSTSGGSPESFMTSMKGTSCLPKDPIQVVSTSVRKSLSVRGCEPMGKNWISCHQLEEWLLMWKKCRRRAEHSCLCLYKRPQCSQRCTGCTCCTSCTWVPLTRNFSGQWSAGGCIWCCTTSWPSAWPSSASMVVMLTSPRGRQVQTSARTGRRARTRARRPELSRVLRRCGVRSVGSGGARLTCRSFSRARGRSRWYLISTAPLVATSTACRVPCPWGATTVPRFFLGAASMPVRSGGEDARRAAGAARDPEAGAAGARRRRARAGSGTAPGEDWRERRRDGRPGSDASGRPRDPVTKRVRQNQSRYRRRPAAGSLARRPSCPGRRSRSTARSPPPEGLRGRRARRWPRGRWRCGPAARRRSCRPRSRRGCRPRLRRGRARAPPGRGARRGARPRSCRGAGRGSAWWRCARRRSTSSGGAASRRRPGLPSAPWPRRSPRRSKTGSCAPRRSTPPPEDGAQRWWRAPRARRPRGAPLLPSLPPPLTSLLLPPQEAAAGEGPCVAGGARADGRSARWSPRAGDAWSRRRARPRGAAARRRRASPGGRRGGLRWAGRGRRCILSIGPGLRARTASRDPRDPKTAERRLRASRSRKVGARFLVLRGFREAGGRCCWSSRRSDGGWWRGAPGPWARLAGCADGRPCPRRGPDTWRGPCSSPAAAPRAPPPRPRGRACAARTRAGAGRAPGRRRRARRGWPAVSGGWSGSRRSRRSGGRLRCWYRSSWPRTSRSGGRVARARGTGASRRACRRCSRCRCARGTGIRRGSAAAAGGRAAIARWRGRRARGPRAGGGSRRCTWTSRCRRRWWRRAGTRGRGSRCCAAAGSSSWWPRSGPGARSRGCSRHTGKNESGQRLDSVAWRLSERVGLRVYPGSNLESGWSRSRGTGTPVSTQACRNLQDTEAGRFLALVAGHEKLVSAESDRPRWLAAVVWRKNRQGCVAVCPGSSLSARRRPDSAANVGVAAPSFPRPLSQPTSPVTERAPLFLVFLPDASRTAADAPPPSTSTAPTAAAAATAGASAPAPAAASHYRGGRRERSRRSVPGLGRGRGAGAAGGVVAGAAPARADEKGRSRGLRAQAEPVQRQERRGARGDARLPLPRGAGAAARPGPKAGAEGRGFRGGRADGDQPRARARGRGQPGHGVRADREGGEQLPKILQQPRAHADRARGGDPGPDAPVGPAGGHRAEPHEQAADGAAVSGGAAQSGQRDVQGGAAEYHRARGPLAPGPGEHSAEHRGAGARAAAVREAGGYQLLGAEPGQVLREDLQDPVRAHRQGGEDRRVLHAHDPESADPERRSGGVPQRQDAPRGERQPPARAERPGADAQPAAGPDRGRDRGGELLHGRGPALAAQPPGLGSCRRFPLRGGGGRGGGGRVPGRLMARPYFCMQQQPPPPDPAMRAALQSQPSGINSSDDWTQAMQRIMALTTRNPEAFRQQPQANRLSAILEAVVPSRSNPTHEKVLAIVNALVENKAIRGDEAGLVYNALLERVARYNSTNVQTNLDRMVTDVREAVSQRERFHRESNLGSMVALNAFLSTQPANVPRGQEDYTNFISALRLMVAEVPQSEVYQSGPDYFFQTSRQGLQTVNLSQAFKNLQGLWGVQAPVGDRATVSSLLTPNSRLLLLLVAPFTDSGSVSRDSYLGYLLNLYREAIGQAHVDEQTYQEITHVSRALGQEDPGNLEATLNFLLTNRSQKIPPQYALSTEEERILRYVQQSVGLFLMQEGATPSAALDMTARNMEPSMYARNRPFINKLMDYLHRAAAMNSDYFTNAILNPHWLPPPGFYTGEYDMPDPNDGFLWDDVDSSVFSPRPATTVWKKEGGDRRPSSALSGRAGAAAAVPEAASPFPSLPFSLNSVRSSELGRLTRPRLLGEEEYLNDSLLRPEREKNFPNNGIESLVDKMSRWKTYAHEHRDEPRASSSAGTRRRQRHDRQRGLVWDDEDSADDSSVLDLGGSGGGNPFAHLRPRIGRLMESEKIKNGTHQGHGDQRAFFSVVCSSMMRRVYPEGPPPSYESVMQQAVAAAMQPPLEAPYVPPRYLAPTEGRNSIRYSELAPLYDTTRLYLVDNKSADIASLNYQNDHSNFLTTVVQNNDFTPTEASTQTINFDERSRWGGQLKTIMHTNMPNVNEFMYSNKFKARVMVSRKTPNGVAVDENYDGSQDELTYEWVEFELPEGNFSVTMTIDLMNNAIIDNYLAVGRQNGVLESDIGVKFDTRNFRLGWDPVTELVMPGVYTNEAFHPDIVLLPGCGVDFTESRLSNLLGIRKRQPFQEGFQILYEDLEGGNIPALLDVEAYEKSKEEAAAAATAAVATASTEVRGDNFASAAAVAEAAETESKIVIQPVEKDSKDRSYNVLADKKNTAYRSWYLAYNYGDPEKGVRSWTLLTTSDVTCGVEQVYWSLPDMMQDPVTFRSTRQVSNYPVVGAELLPVYSKSFFNEQAVYSQQLRAFTSLTHVFNRFPENQILVRPPAPTITTVSENVPALTDHGTLPLRSSIRGVQRVTVTDARRRTCPYVYKALGVVAPRVLSSRTFKMSILISPSNNTGWGLRAPSKMYGGARQRSTQHPVRVRGHFRAPWGALKGRVRSRTTVDDVIDQVVADARNYTPAAAPASTVDAVIDSVVADARRYARAKSRRRRIARRHRSTPAMRAARALLRRARRTGRRAMLRAARRAASGSSSAGRTRRRAATAAAAAIASMSRPRRGNVYWVRDAATGVRVPVRTRPPRTRCLRDVDVSQRRGGCPSANTRKRCSRSSRLRSTAPRRRKESPANSGSKRTKRRRKMWTDWWSLCASSPPGGACSGAGGKNRCCGPAPRWSSRPASVPAPPPSAPTTRCTGTRTSSSRRSSVWASLLTASAAAPRPKRRRCPSRWTTATPRRASRPCSRCCRARRRAGASSARAARICTRPCSWCPSARSWRTCWSTRWTPRCSPRSRCGPSSRWPRAWACRPWTSRSPRSPWKRRPSPSPAPAPWRCRRIPGCRRRLPPLAEDASTARPACCPTTRCILPSSPRRATAARASTAATPAAAARPPPAAAVVAPAAAAPRLPPPPWCGECTAAGASLPCRARATTRASPFNSAVASYLQIWPSHAASASPLRATEEESRAVEGRGTGCVAITTGGGAPSASGWGEASCPRSPSSPRRSGRSPALPWRCRPLSATETQLGKFVIKKWTDAPGPVMCVFRWKTSIFRPWHRDTARGRLWAPGATSATANTGAPSIGAVSGAGLRISGPRSKPMATRRGTAAQGRRGKSKSRTSSRRWSMAWPRASTGWWTWPTRPCRNRSTAAWTRSRPRGPWRCPRWRRSCLPWTSAATSDRVPTRRRRCRTRTSRPRTRRRNWVCPPRGPWRLWPPGCNPAAAASPRPWTCLRLLPAPPQWLSPCRRWPSRRAPPEAAPRRTGRALTASWVWECRVSAAAAIKRHCSALACLCVYVCPPTRRRKRRVAELQDGHPIDAAPVGVHAHRRTGRFGVPESGSGAVRPRHRHLLQSGEQVEPHGGAHARCDHRPQPAADAALRARGPRGQHLLVQSALHAGRGRQPRAGHGQHLLHPRRAGSGAQLQTLLRHRLQQPGSQGSAQHLPVDISWYYRKNLYIWKCTCARHHYKGWYSTWNQRWSGNLCRRNLSTRASSGCMAHHWYKIWRQSSAHQNEALLWFFCQAYQRRRPGKCENRNRRYQRIHHGILRSKCSCRRPSPRNCFVYECGSGNSRYPYCIQGRYRQLFYQFGSAVHAQQTQLHWLQRQLYRSDVLQQHWQYGCTGWTGLPAECCGGLAGQKHRTVLPALALSGQNQVFQYVESGGGQLPRCAHYKSRCGGTSLLLPPGCCGNYLPGNGQWSNHLDQRYCCIGQGQSFRHGDQHPGQPVAELPLRERGAVPARLLQVHAGQHHAAHQHQHLRLHERPRGGALAGGRLHQHRGALVAGPHGQRQPLQPPPQRGPAIPLHAPGQRALRALPHPGAPKVFRHQEPPAPARVLHLRVELPQGRQHDPAELPRQRPAHGRGLHRLHQHQPLRHLLPHGAQHRLHARGHAAQRHQRPVLQRLPLGGQHALPHPGQRHQRAHLHPLAQLGRLPRLVLHAPQDPRDALARLRVRPLLRLLGLHPLPRRHLLPQPHLQEGLHHLRLLRQLARQRPPPDAQRVRNQAHRRRRGVQRGPVQHDQGLVPGPDAGPLQHRLPGLLRARGLQGPHVLLLPQLPAHEPPGRGRGQLQGLPGRHPGLPAQQLGLRRLPRAHHAPGPALPRQLPLPAHRQERRRQRHPEKVPLRPGHVAHPLLQQLHVHGRAHRPRPEHALRQLRPRARHEFRSRPHGVHPSLCCLRSLRRRPSAPAPPRRHRGRLPAHALLGRQRHHLSLLLLARRPARAPASRSSGPSSATWAAGPASWAPSTSASRDSWPRTSWPAPSSTRPAARPGASTGWPSPGTRAPTPATSSTPSGSRTSASSRSTSSSTRACCVAAPWPPRTAASPWKSPPRPCRVRARPPAGSSAACSCTPSCTGPTAPWTRTPPTCRGCPTACSSRPRWNPPCAATRRRSTASSTPTPPTFAPTARASRRPPPSTAIKTCNPVCVCECFIHHNKQHMFMPPSLRLLYLEIEGVLPALGMARGQGYVAELVLGQPLELGDQQLRHGEVGERVAPQLARELQGAQQVGRGDLEIAVGTRVLRARVTVHGVAALEHHQGRVLHARQHRRVGDALHVQILGVGHPEGGHLAGLPPHAGHAAGLVVAIAVQGDQHHLGLLGAHARVHGLHESLQLAEGLLRLAALGEEDPAGLARELVGGAASVVHAAARVVVGQLHHAAPPAVLGDLGPVGVLLQRALPVLARHIHLDRVLLLDHHGPVQAPQLALGLGAPVQPQRAAGALPVLVGDLGVRVHEALQEAAHHRGQGLVAGEGQRNAAVLLVHIQVADTAVHLALLGHQLEGGLQVALHAVPVHQQRHHFHALLPGRNDRQAQGVLHRCHLSRRRRSQGVVLVQGLKHSLAVLLGDAHGGKAEAHGRQLLLGLPFVLAVLADVLQRHMLGLAGFLFGRQRRRRRRAGRARVLAHHDYFFSLAVVRDHAAVGMPLLGQRRRRRALAVRRAAGRAPSAFGGALLAALLLTSSAAGHCVLLGSKHGDSAIVANIAICPRRRRREPAAAEKLNRPAAQPHLRRRSPRHARDGGIHRDPGLRDARGARGGAGSALFSPGREPPRAARAGSRERAEPGWARAWRLPERGRGRAHQASGPPMHHRQGRAARPRRGAPQRGGAQPRLRAQPLLAARAPQAPAQRHLRAQPAPQLLPGLRGARGPGHLPPLFQEPKDPRLLPRQPHPRRRPAQPGPRRPPTYRLLGRGSQDLRGSGQRRDSGRERSARKRRGAAPQRPGGVGRRQRAPGGPQAHGRADPLRLPGAQPAPQGHERRHGPGAHQARLAPLGGGDAGPRELGRGQARGQRRAAGALAGSEHPPEPGRAAQAHDGRGPGDRGAGVSAPLLRRRGDPAQGRGEPALPLQTRVRAPGLQDLQRGADQPGLLHGHPAREPPGAERAAHHPARGGPPRLHPRLRLPVPLPHLADGHGRVAAVPGGAEPERALQAPAEEPQGPVDRVRRAHHRRGPGRPHLPRAPAADAAQRAARLYEPKHVAKLSLFHPRTLRDPARHLLRAALGLRAADLPRVPPAALEPLLPAAPGQLPGLPLGRDRGRQRRGPARVPLPLQPLHAAPLPGLQPPAAERDPDHRHLRVARPRRGQGGSETHPGAVDLGLLAQVRARGLPSLRDQVLRGPIPAAQGRAVGLRHHPGGHPGPIASHPEIPPRISAEKGPRGLLGPPDRRGAQPQLPPGCPEEAARSKWSCRRRRRIWRKTGRAVRQRRRRWKTGTALRQRRTACKTVWRRKTRWRRQRKKQPPPDRRPRRRRRKQAARIPSPLRVGVAAAGPTVDGTRPGASRTPPPRPVRRSGRDTSPGGGTKTPSSPACKPAGATSPSPGATCSSTAGTSPATSCITTVTSTAPTTVSKKRQKPSSSSSSRKPAAAARKSTAAAGGLRIAANEPAQTRELRNRIFPTLYAIFQQSRGQEQELKVKNRSLRSLTRSCLYHKSEDQLQRTLEDAEALFNKYCALTLKEPAPAHTRKKAGITSPPAPFARPSSAKRFPRLTCGATSPRWAWPPAPPRTTPPATGSVPGPRSHGMTSAPTETRYSNSQRSPPRPAITLIRVIGPPPWCTRKFPSPRPYYFRETPRPKSSLTQVSSWPAAPPCVVTAPLRVSGWSEAEAHSSTTRWALRWVCDLTESSNSPDRGDLPSRLVRPSLWRVRPRSPARVASALSSSWRSSLPRSTSTPSPAPPATTRTSSSRTSTPSASRWTATIECPMVARLTLGFDTWTTAAASAASLGISPSLPTLSCPRSTLRARPTECGSSSKGVSTPTCFGSSASVRSWPSASKDRPFPCTASATTPACMKVFVVCCVLSIIKAEISDYSGLPCVPAINQSLFFTGNETELQLQCKPHKKYLTWLFQGSPIAVVNHCDNDGVLLSGPANLTFSTRRSKLQLFQPFLPGTYQCVSGPCHHTFHLIPNTTASLPATNNQTTHQRHRRDRGHVQSSRSTRPQYMPILDYEAEPQRPMLPAISYFNLTGGDDPTGQQQRQRPSPGHGRPRLGAATRPTSHSPAAGESRQGAAGRHSHPPVQERHLLPGETGQDLLRGHPDRPSPLLRAPAAAPEVHLPGRSQPHRHHPAVGRYQGVHPLLLRLPRLRPHSDQDPLRPPRPPPHELITPLSSEINIILMMIIKNNHLINKDTIILMIVLKNKESLTNLIPGLCPCFLPTPPHSPLPSSGTADPGGLQTSSTRRGCQIPPVPQSSFYLLSDVQKARPGGLRPRLPLRCRQRTDRALHQPPLRLFRWIPREAPGGAVPATGPRHHQERGNHPQAGRGGGPRLLGKTHLQHGHQGRRPSQFFQQHHFPHGYPSLYQRWKIILTSFSTVKHIKINHSEHISCSLWIRFRTEWWHCSCSTVGLSTHFKRKYNPSQWSINSCKSTYQLQKRGHCHYLRRCNKQHKLARYKIRWHSCKHWQRIGIWNHYRDCHRCIPNSSIGYWPYLQYRRHCCLEQRGTYIMDHSRPLAKLQNILKRCQTHTLLDKVWKSNSGYCDCIGSEWKSQPNHKHSKHCTRLPQVCKWSFAKQLHIRQRILELQKGRCYTCALYCYRFYAHKGLSKHICSFKKPYCQSSLSQWGGQTTDADYYFNGCNLHLQYHFSMEMGYVHRNTCYQLLHLLLHRPRMNTVSHPACQPFPPHSVYGKNSEAQNKIKFKCFIDSTVLQDSSSYFSSTLPGHGIHHPLPPHSLEHLNAIGDGHAFGLHVPHSFRASQSRVGQGDETLRALPHLHLTAQQLRIVLGGRDHGYLEEAEERRWESSANGIGRWCRIRPRSSRCRRRSVKLLLRGSGSRDSLSMMPTALSISRLVRRAQQRMRISLRSLQYVQHRTTRLFNSPFNTLQPKLIAGRMLPTWPSYQILRIKWRSLQNTLPTYMISLGMWRFTTSRYHITLWLNMQPRMILRNHRASTAPPAMQRRDPGSRQWQWRTHRSYPWIIWELNKSMLAQHRHMLMHLFSTLSSSGVKTISQGTGNSCRTANPAEQGNPRTLTLCMDRVSQSGSTGSSTREARVSVSSQRGKGAGRYGWRDAADRVRDRVMMQLLSDIFVLAVAEPGPGAAHRSPAAVPALGTLGVEIVKQPLSQTVQQIGLRSDEDPIMPDSSDHIDHRGMGQTQPDDAILLGFGDGGGGKNRKNHDLLIQTVSEHFKMKVAEMAPLAPAVLVENNSQVKGDTVLEMFHGGFQQSLHAHIQKQDNSESGRVLFLNHHVTLLHHPQIIFIFPALNDSNFLRIQASHDKELAQSALHRHSAHPHNSKIFCSWFTCSRLTSGISKSLPRSLSSSLSNNCKYSFISSPKFLAIGPPGIRLGQATVQINRSPPQALPNARLLACWLDPVISSRLDRKSPRQFLRKSTKEKSSRCTFRASGTTMKMQAVRSSMVSLICKKQKIKHTMLAWRTGGIVLSSTRQATGSPARPSKLSLLKTITERRSRWPAMIRQDEYTPGTLASASEKKRPRKQGTTMLSLKSSKAMPCGSTKSSGAYKMLLPSCTGSEAPDPSRYTYKASASIAYRAAAHNRRKSQRKAELPVHPLSAQYIAQIYTDVKAKVKYPPNNHTRPAHAQKPVTHSKKYAHFLKRPNCRHFRVPTLRHRNSTFKFRRPLKTSPAPPLTVARLSANHLPPSPNSNSSFAYRAPKVGILLMM

SEQ ID NO: 13 - protein, 11238 aa, Artificial Sequence
  Artificially Synthesized
HHQYTSNFWCALICKAVIWGGRKVIGCGSGDRGRGGRFDDVAMRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLRLEYLIRLTIGLRLEFDATMRVMGILRSYQQWWIWGILGFWMLMICNVWGNLWVTVYYGVPVWKEAKTTLFCASDAKAHKEEVHNIWATHACVPTDPNPQEIVLKNVTENFNMWKNDMVDQMHEDIISLWDQSLKPCVKLTPLCVTLNCSDVKIKGTNATYNNATYNNNNTISDMKNCSFNTTTEITDKKKKEYALFYKLDVVALDGKETNSTNSSEYRLINCNTSAVTQACPKVSFDPIPIHYCAPAGYAILKCNNKTFNGTGPCNNVSTVQCTHGIKPVVSTQLLLNGSLAEEEVVIRFENLTNNAKIIIVHLNESVEINCTRPSNNTRKSVRIGPGQTFFATGDIIGDIRQAHCNISRKKWNTTLQRVKEKLKEKFPNKTIQFAPSSGGDLEITTHSFNCRGEFFYCYTSDLFNSTYMSNNTGGANITLQCRIKQIIRMWQGVGQAMYAPPIAGNITCKSNITGLLLTRDGGKEKNDTETFRPGGGDMRDNWRSELYKYKVVEIKPLGIAPDKAKRRVVEREKRAVGIGAVFLGFLGAAGSTMGAASMTLTVQARQLLSGIVQQQSNLLRAIEAQQHMLQLTVWGIKQLQTRVLAIERYLKDQQLLGIWGCSGKLICTTAVPWNASWSNKSYEEIWGNMTWMQWDREINNYTNTIYSLLEESQNQQEKNEKDLLALDSWESLWSWFNITNWLWYIRIFIIIVGGLIGLRIIFAVLSIVNRVRQGYSPLSFQTLTPSPREPDRLGRIEEEGGEQDRARSVRLVNGFLALAWEDLRSLCLFSYHRLRDLILIAARAAALLGRSSLWGLQKGWEALKYLGSLVQYWGLELKKSAISLFDAIAITVAEGTDRIINIVQRISRAFYNIPRRIRQGFEATLQGTSRVDPGGQTADQPRLCLLVASHLLFAPPPCLPPWKVPLPLSFPNKMRKLHRIVVGVILFWGVGWGRTARGRIGKTIAGMLGMRWALWLLRRKEPADLQIIHLCRVRRKRNGIMGIMGLHIGQISTYAGHRACGLAPPQDMARVRAQRHDPLQCAPGLPPRHVHALPVQHAICEGAAGARCHVQSEPDGGVHECGAVENSEIIQDQVPGLRMRRQARQASARVCGGDGGPATRSFGVVLQRDGVRLQRGRILEVVFGAGCEPAGAELKSVVFCVLQQHERKRLLGRGIQPLSDGASPLLGGSASECDGIHGGRPARAARELFNPDLRDPELLVRGRSCRRSCCFRRQRRARNGPGRRLLQLSGGQLEFHQSRQPERGEAAAADGPARGPDPAPGRADPAGGSAAGGDAGRGCHGENQIKNESINKRRRLLILTQSLESLFDFSRAVGPGPPVSIIEHPVDLFQDPVEVGLDVEVHGHEPVPGVEVAPLQGLVLGDGVVNHPVIAGAQGVVLHDVLEEETDGHGQPLGVGVDEPVELGGMHAGGDEMHLGLDLEIGDVPAQIPPGVHVVQDHQHGVSGALGEFVMQLGREGVKEFGDALVTAQVFHALIHDDGDGPVGGGLGKDVSGVGHIVVVVLGELVIGHFNEFGAEGARLGDEGALDPGGVVALADLHLPGLELGGGDHVHLRGDEKNGFRGGGDELGRKQVPEQLGLAATGGAVDDPDDRLQVVVEGETAAVLAEEGGHLVHHLAHMHVLAHEFRQEALAPQREELLQRGEVFQRLESVGHGHFGEGLLQEFQTVPELGDVLGISIQQTSSFRGLGRLREGTRRWASSEARVRSFQGRRVRVSVVSVTVKGCAPGWALARVRFRLIRLVENRSRSAPCASARQLSMSSLSASAAWPLARSLPLEVCPQTGQRRDLRASLGARKTDSGAASAPQLAQTVSHSTSQVRSGRLGSKTRFPPCFLMRFLPLVSMSSCPRWVTKRLSVSPTDFMGRSSSGVPRSSSRNPAHSETKARVQASTKEATWEGRSLSTSGSTFSRVCKHMSPSSTSRKVIGLVATPGVPAGGVKGAGPCSSSLSSGSLSRSASCWGRYSLSKAGMTSALRLSVSRNEEDLILTVPLETPFMSPSSIWSEKTIFLLSSLVAKEPRALESSLAMERMVWFFSLSARSLAAMLSCTYSRATHFHSGKTVVSSSGTILTRQPRLCRVMRSTLVATSPRRGSLVQQRRPPLREQKGGSGSSMSSSGGSASTVKMPGRSSGSKLMQVPRLSSAACQSRTASARSGLRGVPQGMGCVSAEAYMPQMSTRGSSRTPMVGQRPPRMLARTSYSSCEGARSPVPRLERCGFSARTIWRKMAWELEEMVGLWKMLKWAWGRPTESLMKWAESCSLATSSAVTRTSRAQSRVSWMMSYLSWPFCFHSSRLRRNSSRSFQYSSRGNPSSAREPTMNWLTALAQQPFSTGRAACAALRREVWVRAKVSRTMTLRNWCLKSRSSQPPCSQSWKSVRFLAGLGKAKVTSLKRILPARGMKLRVMRKGWGTSARLLMTWAARTISSKPLMLCPTMSSTNRGRPLTWGSFLSSSVSSAGSLSPCCSRAQSATWGLALRKEVQRSTARAVCKRSRYRNCWPTAIFSGVTQKVRGSPCQRSHLSWRARSWASSTSGGSPESFMTSMKGTSCLPKDPIQVVSTSVRKSLSVRGCEPMGKNWISCHQLEEWLLMWKKCRRRAEHSCLCLYKRPQCSQRCTGCTCCTSCTWVPLARNFSGQWSAGGCISCCTTSWPSAWPSSASMVVMLTSPRGRQVQTSARTGRRARTRARRPELSRVLRRCGVRSVGSGGARLTCRSFSRARGRSRWYLISTAPLVATSTACRVPCPWGATTVPRFFLGAASMSVRSGGEDARRAAGAARGPEAGAAGARRRRARAGSGTAPGEDWRERRRDGRPGSDASGRPRDPVTKRVRQNQSRYRRRPAAGSLARRPSCPGRRSRSTARSPPPEGLRGRRARRWPRGRWRCGPAARRRSCRPRSRRGCRPRLRRGRARAPPGRGARRGARPRSCRGAGRGSAWWRCARRRSTSSGGAASRRRPGLPSVPWPRRSPRRSKTGSCAPRRSTPPPEDGARRWWRAPRARRPRGAPLPSPPLPPPLTSLLLPPQEAVAGEGPCVAGGARADGRSARWSPRAGDAWSRRRARPRGAAARRRRASPGGRRGGLRWAGRGRRCILSIDPGLRARTASRDPRDPKTAERRLRASRSRKVGARFLVLRVFGREAGGRCCWSSRRSDGGWWRGAPGPWARLAGCADGRPCPRRGPDTWRGPCSSPAAAPRAPPPRPRGRACAARTRAAAGRAPGRRRRARGWPAGSGGWSGSRRSRRSGGRLRCWCRSSWPRTSRSGGRVARARGTGASRRACRRCSRCRRARGTGIRRGSAAAAGGRAAIARWRGRRARGPRAGGGSRRCTWTSRCRRRWWRRAGTRGRGSRCCAAAGSSSWWPRSGPGARSRGCSRHTGKNESGQRLDSVAWRLSERVGLRVYPGSNLESGWSRSRGTGTPVSTQACRNLQDTEAGRFLALVAGHEKLVSAESGRPRWLAAVVWRKNRQGCVAVCPGSSLSARRRPDSAANVGVAAPSFPRPLSQPTSPVTERAPLFFSCVFARCIPYCGRCAPTLHHNRPYRSSSNSRRFCPRPSSSQPLPRRPPAEPAFSMTWPWKRARGWRGWGRRRRSGTRACRKGTLARPTCPSRTCSETGAARSPRRCAPPASTRGGSCGAAWTESGCGTRISRRTSRGSAPRARTWPRPTWSRRTSRPRRRATSKNPSTTTCARSRARRPWACTCGTCWRPSCRTPRASRRRSCFWWCSTVGTTRRSGRRCISPSPRAAGSWTWTFCRASWCRSAGCRCPRSWRPSTSRCVWASTTLGRSTRPRTCPTRRRSTGFTCAPKCPATIWGCTATTGCTARAPAAGASATRSCTACSGPPGPGPRGRATLTWARTCAGSPAAGPWKLPAVPPTWRRWTMRRRRASTWKTDGATVFLLDAATATAAASSRDAGGAAEPAVRHLLGRLDPGHATHHGADDPQSRSLTAASGQPALGHPGGRGALALEPHAREGAGHRERAGGEQGHPRRGRAGVQRAAGARGPLQQHQRADEPGPHGDRRARGGVAARAVPPRVEPGLHGGAERLPEHAARQRAPGPGGLHQLHQRAAADGGRGAPERGVPVGAGLLLPDQSPGLADREPEPGFQELAGTVGRAGPGRGPRDGVEPADAELAPAAAAGGALHGQRQREPRLVPGLPAPVPRGHRTGARGRADLPGDHPREPRAGPGGPGQPGGHPELPADQPVAEDPAPVRAEHRGGAHPALRAAERGAVPDAGGGHAQRGARHDRAQHGAQHVRPQPPVHQADGLLASGGRHELGLLYQRHLEPALAPAARVLHGRVRHARPQRRVPVGRRGQQRVLAASRNQCRVEERGRGPAAVLGAVRSRGCCRGGARGRQPLPEPALFAEQRAQQRAGSADATAPAGRGGVPERLLVEARAREELPQRDREPGGQDEPLEDVRARAQGRAPSQRRHPTPAARQAAGTGVGRGFRRRQQRVGLGWEWWPVRSPAPPYRAPDVRIKNKRRYSPRPWRPACVLLCCLYDEARVPGGSSSLVRERDAAGGGGGDAAPAGGALRAPAVPGAYGGAEQHSLLGAGTLVRYHPVVPGGQQVGRHRLAELPERPQQLPDHRGAEQRFHPHGGQHPDHQLRALAVGRPAENHHAHQHAQRERVHVQQQVQGAGDGLAQDPQRGGLWSGRADLRVGGVAARGQLLGDHDHRSDEQRHHRQLLGGGAAERGAGERHRREVRHAQLPAGLGPRDRAGDAGRVHQRGLPPRHRPAARLRRGLHREPPQQPAGHPQAAALPGGLPDPVRGPGGGQHPRALGCRSLREKQGGHRRGDRSRGHRLYRGAGRFCRCGSGRGGNRKDSHPAGGEGQQGQELQRARGQEKHRLPQLVPGLQLRRPREGRALLDAAHHLGRHLRRGASLLVAARHDARPGHLPLHASSQLPGGGRRAPARLLQELLQRAGRLLAAAARLHLAHARLQPLPREPDPRPPARAHHYHRQKRSCSHRSRDPAAAQQYPGSPARDRHRQTPHLPLRLQGPGRSRAARPLEPHLLKNVHSHLAQHRLGPARAQQDVRRRSPTLHATPRARARALPRSLGRPQGPRALAHHRRRRDRPGGGRRAQLHARRRARLHRGRRHRQRGGRRAPVRPHQEPAAAHRPAAPEHPRHARGASLAAQGQAHGTQGHAQGGQTRGLRQQQRRQDPQTRGHGGGGGHRQHVPPAARQRVLGARRRHRCARARAHPPPSHLKMLTSRCCVPAARRMSKRKYKEEMLQVIAPEIYGPAAAVKEERKPRKLKRVKKDKKEEEDDGLVEFVREFAPRRRVQWRGRKVKPVLRPGTTVVFTPGERSGSASKRSYDEVYGDEDILEQAVERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTSTRRRRKYGAASLLMPNYALHPSIIPTPGYRGTRFYRGYTSSRRRKTTTRRRRRSRRSSTATSALVRRVYRSGREPLTLPRARYHPSIAILPPPTCRYGPHMPPPRPHYGLPRKKAAPKADGERAASPSPPAAARHQQAVGGRLPARADPHHRRGDRGDPRHSFRGGAGLSAPLRHKKAWICNKKKNGLTLLVLCVFLDGRHQFFVPGTATRHAAVYGHLERHRQQPTERGRLQLEQSLERAEFRVHAQNLWQQGVEQQHRAGAEGKAERTELPAEGGWPGLRHQRGGPGQPGRAETDQQPPGRGPARGVRGDAPGGGGAASPGQARRQATASRRGGDAADAHGRAAPVRGGGETGPAHHAARGASGHRSAETQQQPARDPGLASASPLHSGAPAAGGRRVARPPRPPPGELAEHSEQHRGSGSAECEAPPLLLKDTVALNLLVCVYMYVRRPEGGVRGASPSCKMATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQAKTGNGGTMETHTYGVAPMGGENITKDGLQIGTDVTANQNKPIYADKTFQPEPQVGEENWQETENFYGGRALKKDTNMKPCYGSYARPTNEKGGQAKLKVGDDGVPTKEFDIDLAFFDTPGGTVNGQDEYKADIVMYTENTYLETPDTHVVYKPGKDDASSEINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKDGQDGDVESEWENDDTVAARNQLCKGNIFAMEINLQANLWRSFLYSNVALYLPDSYKYTPTNVTLPTNTNTYDYMNGRVTPPSLVDAYLNIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATTAALASCKMTAGSGEQELRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDMKTGVCMMLYSTAHVYATFSEALTLFRNRRGSAGSRHGPRAGIRCGTGTWAATTRGSAAWARGGRGTSRSTACAVAGRPAGRARRSNRSWDPRSARESCGTRGCSTGTPSGPGASRLPAPSRRCPPRPDPRRWPSRRGSSCRSAAPCWARSRACGCNRSAGGSASSGPARSSCPGTWPSKPPAGGRPAAPCRPRRRPRRTCRTGWWRSRRRARSSARRCWPAAPRCAPSGSGSWPGWGSPSARAARSRSPHPSRCAPSGSSRSRAGTAACPRLRCSRAATARSRCTPSSCGRSGSASARSPAGSGPSSRSGSCCWRSAGCRGAPRSHTGGRCGGTPRPARASAGRRTSGRSPRGTGPSAASSLPCPSPRPKRSAGSGGSSPPLSSSPPPRSGGRSRPGSQTLACRPSRCARGESSPRPPAPPRPAFRPRCPGCLAKAHAWSCGVSFWAAEAAAMCWESASSRSPRLFLLLGRRPRPRGGRHASSGAEAEATGSRGSAGGWQSPFRVRGCAPGGAALTDFLRGRPLCSPREQQQAWRLSHRRQHRHLPPPPPPTRTSSRMKAPPRRPAPPPTPRPQTCKRWRNPSRLTWATRPRSTRRSWQRAFQPRKRTTKSSQSRKQRTSRTRLGTSMATTAGQRTCSSSIWPANASSSRTRCSTAPRCPSAWRSSAAPTSATSSRRACPPSASPTAPVSPTRASTSTRSSRCPRPWPPTTSFSRTKGSPSPAAPTAPAPTPCSTWAPAPAYLISPPWKRFPRSSRVWAATRLGPRTLCKEAERSMSTTAPWWSWKATTRAWRSSSARSSPTSPTRRSTCPPRSAPSWTRCSSSAPRPSRRRRCRTPRVRTRASPWSATSSWRAGWERVAPPRAWKSGASSWPWSWPWSWSVCAASLPTRRPCARSRRTCTTSSGTGSCARPARSPTWSPTWSPTWASCTRTAWGKTCCTPPCAGRPAATTSATASTCTSATPGRRAWACGSSAWRSRTKSSASSCRRTSRPCGPGSTSVPPPRTWPTSSSPSACGRCATGCPTLAKACCKTFALSSSNAPGSCPPPAPRCPRTSCRPSASAPRRSGATATCCAWPTTWPTTRTSRTSAARVCWSATAAATSARRTAPWPATPSCARPRSSAPSSCKAPATARARGVNSPRGCGPRPTCASSCPRTTIPSRSGSTRTNPSRPRPSCRPASSPRGPSWPNCKPSRNPAKNFCKRATGSTWTPRPERSSTPASPRMPRGSSKKLKVELPPPEDLEEDWESSQAEEEEMEDWDSTQAEEDSLQDSLEEEDEVEEAEEEAAAARPSSSAEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQKTSGSSSKIHSGGRWTEDRGERAGADPGAEEPDLSHPLCHLPAESGAGAGTESQEPFSALAHPQLSVSQERRPTSAHSRGRRGSLQQVLRAHSRVARARPHTEKGGNYVTTCALRPTIMSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYDMSHGGAADLARLRHLDHCRRFRCFARDLAEFAYFELPEEHPQGPAHGVRIIVEGGLDSHLLRIFSQRPILVEREQGQTLLTLYCICNHPGLHESLCCLLCTEYNKSDQRLLRTRLWCSCYQPVPVLHRERDRAPAPVAPQEVPHLAVPGLPDRRCQPLRQRRSPAERPCQPYFFHPQKQAPALPTLPPRDLSVRLRTLPSHLPPDPEYHSAAPRYQPNYPPTPPSRPFLIYHYRRWLLLLVLPRPVDPRSPTQSPEEVRKCKFQEPWKFLKCYRQKSDMHPSWIMIIGIVNILACTLISFVIYPCFDFGWNSPEALYLPPEPDTPPQQQPQAHALPPPQPRPQYMPILDYEAEPQRPMLPAISYFNLTGGDDPTGQQRQRPSPGHGRPRLGAATRPTSHSSAAGESRQGAAGRHSHPPVQERHLLPGETGQDLLRGHPDRPSPLLRAPAAAPEVHLPGRSQPHRHHPAVGRYQGVHPLLLRLPRLRPHSDQDPLRPPRPPPHELITPLSSEIKIILMMIIKKIIIFEIKIQSYFEFNKNKESLTNLIPGLCPCFLPTPPHSPLPSSGTAGPGGLQTSSTRRGCQIPPVPQSSFYLLSDVQKARPGGLRPRLPLRCRQRTDRALHQPPLRLFRWIPREAPGGVVPATGPRHHQERGNHPQAGRGGGPRLVGKTHLQHGHQGRRPSQYFKQHHFPNCCPFLQQQWNFKPQCLHTISSISHIHFRHKSWKRSSDFKVVDCTTNSSSYIQLKHHSKNRQRAIYLQWKQRTGYKPKKRTSFRCYCNIYWKWLRLWILWKNKTRNYQNWSRIKFCQSNSCQTRHRFKFLRWCLDSWKQTGQANTLDYPPKPLSITFRQRCQIYSLSYKMRSNTRHCGSGGCYCRISTKSNHSQKRHSFPIFRWCTHVKLINGRLLELGGTDHSKCSLYKCCGIHAKYRCISKNPKNTKHSQSGIFNWRNYYANDTNHNFQWHKRHNPSHLLYDFYMAVDWRLGQKYYLCYQLILFFLHRPGIIPPSKPTPFPTTFVYMETLKQKNKVQVFYINSFTGLEQLFFLHPPRTWNTPPSPPAQPTSECHWWTCFWSPRSTQFQSEPVSDRSGRNPPGTPASAPHSSTAEDCPRWSGSRLSGRSRRAAVGIIVRERDRPVVSHQAPQQSLPPPLRQAAAQGVRVQGLPQHDAHGPQHQSSGAAGAAAHANLAQVTAVRATQDHQVVQQSIVQHAPAETHRGKDATHVAVVPDPQVNQVALPPEDAAHVHDLLGHVAVHHLPVPHHPLVEHAAPDDPAEPQGQHRPARHAAKRPRIPAMTMEDPPLVPVDHLGAEQVYVGTAQAYAHASLQHSQLLGGQNHIPGHGELLQDSEPRRTGQSSHITYIVHGQGIAIRQHRVILHQRSAGLGLLTAWGGRPIRVMAGRGSCSRPCHDAVAFGHFRTCCSRTWSGRCTPIAGGGLGAWNARCSCKTATLSDRAADLGPQERSHHALSHRPPWNGPGPARCNFVGFRRRGREEQEEPLTFNPNGLGALQNEGHGDGTSRPRCVGGKQPGQRYGSRDVPRWLPAKPPRAHPETRQRKREGSLIPQPSCYTPAPSPDNFHFSSLEFELVPEVNPSQPKARAEHPPPAFLSTPSFQDILLLVHLQQIDKRNIKISAAIPELLPQQLVLFHIVSEIFSHRTPRNKRRASHITDKPKSPPVSIAKCKIEISMLARPGDIFQITGQKIGAIFKKINKRKIFQVHVGLGNNDGVSARGAFQHGLADLKNKKNIKPCPGEQVGKSFSPAPGRPRGLRRDPRKNCRYDKPSQRDVPGGRREFEKKHTPPEHWSPVKKSGRGSNEALQRSLSSPAKRCHADEAQNFQVRKKCNYSPPAQAAKLPIPPDTHTKPQRPLTERQQQRHTTGARVREKTELPVRPLSAQYIAPDLHRKGQSLKIPAKSHTPSTRPETGDTLRKIRALPQTAKLPSFPGSHATSSKHDFQIPSTVKNITRPAPNGRRSRSQSPSSLPKFKQLICILTRTKSLRYIIDD

SEQ ID NO: 14 - protein, 11224 aa, Artificial Sequence
  Artificially Synthesized
HHQYTSNFWCALICKAVIWGGRKVIGCGSGDRGRGGRFDDVAMRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLRLEFDATMRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVEIKPLGVAPTKSKRKVVGREKRAVGLGAVLLGFLGAAGSTMGAASITLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWYIKIFIMIVGGLIGLRIIFGVLAIVKRVRQGYSPLSFQTLIPNPRGPDRLGRIEEEGGEQDKDRSIRLVSGFLALAWDDLRSLCLFSYHQLRDFILTAARAAELLGRSSLRGLQRGWEVLKYLGNLVQYWGLELKRSAINLFDTIAIAVAEGTDRIIEVIQRICRAIRYIPTRIRQGFEAALLGTSRVDPGGQTADQPRLCLLVASHLLFAPPPCLPPWKVPLPLSFPNKMRKLHRIVVGVILFWGVGWGRTARGRIGKTIAGMLGMRWALWLLRRKEPADLQIIHLCRVRRKRNGIMGIMGLHIGQISTYAGHRACGLAPPQDMARVRAQRHDPLQCAPGLPPRHVHALPVQHAICEGAAGARCHVQSEPDGGVHECGAVENSEIIQDQVPGLRMRRQARQASARVCGGDGGPATRSFGVVLQRDGVRLQRGRILEVVFGAGCEPAGAELKSVVFCVLQQHERKRLLGRGIQPLSDGASPLLGGSASECDGIHGGRPARAARELFNPDLRDPELLVRGRSCRRSCCFRRQRRARNGPGRRLLQLSGGQLEFHQSRQPERGEAAAADGPARGPDPAPGRADPAGGSAAGGDAGRGCHGENQIKNESINKRRRLLILTQSLESLFDFSRAVGPGPPVSIIEHPVDLFQDPVEVGLDVEVHGHEPVPGVEVAPLQGLVLGDGVVNHPVIAGAQGVVLHDVLEEETDGHGQPLGVGVDEPVELGGMHAGGDEMHLGLDLEIGDVPAQIPPGVHVVQDHQHGVSGALGEFVMQLGREGVKEFGDALVTAQVFHALIHDDGDGPVGGGLGKDVSGVGHIVVVVLGELVIGHFNEFGAEGARLGDEGALDPGGVVALADLHLPGLELGGGDHVHLRGDEKNGFRGGGDELGRKQVPEQLGLAATGGAVDDPDDRLQVVVEGETAAVLAEEGGHLVHHLAHMHVLAHEFRQEALAPQREELLQRGEVFQRLESVGHGHFGEGLLQEFQTVPELGDVLGISIQQTSSFRGLGRLREGTRRWASSEARVRSFQGRRVRVSVVSVTVKGCAPGWALARVRFRLIRLVENRSRSAPCASARQLSMSSLSASAAWPLARSLPLEVCPQTGQRRDLRASLGARKTDSGAASAPQLAQTVSHSTSQVRSGRLGSKTRFPPCFLMRFLPLVSMSSCPRWVTKRLSVSPTDFMGRSSSGVPRSSSRNPAHSETKARVQASTKEATWEGRSLSTSGSTFSRVCKHMSPSSTSRKVIGLVATPGVPAGGVKGAGPCSSSLSSGSLSRSASCWGRYSLSKAGMTSALRLSVSRNEEDLILTVPLETPFMSPSSIWSEKTIFLLSSLVAKEPRALESSLAMERMVWFFSLSARSLAAMLSCTYSRATHFHSGKTVVSSSGTILTRQPRLCRVMRSTLVATSPRRGSLVQQRRPPLREQKGGSGSSMSSSGGSASTVKMPGRSSGSKLMQVPRLSSAACQSRTASARSGLRGVPQGMGCVSAEAYMPQMSTRGSSRTPMVGQRPPRMLARTSYSSCEGARSPVPRLERCGFSARTIWRKMAWELEEMVGLWKMLKWAWGRPTESLMKWAESCSLATSSAVTRTSRAQSRVSWMMSYLSWPFCFHSSRLRRNSSRSFQYSSRGNPSSAREPTMNWLTALAQQPFSTGRAACAALRREVWVRAKVSRTMTLRNWCLKSRSSQPPCSQSWKSVRFLAGLGKAKVTSLKRILPARGMKLRVMRKGWGTSARLLMTWAARTISSKPLMLCPTMSSTNRGRPLTWGSFLSSSVSSAGSLSPCCSRAQSATWGLALRKEVQRSTARAVCKRSRYRNCWPTAIFSGVTQKVRGSPCQRSHLSWRARSWASSTSGGSPESFMTSMKGTSCLPKDPIQVVSTSVRKSLSVRGCEPMGKNWISCHQLEEWLLMWKKCRRRAEHSCLCLYKRPQCSQRCTGCTCCTSCTWVPLARNFSGQWSAGGCISCCTTSWPSAWPSSASMVVMLTSPRGRQVQTSARTGRRARTRARRPELSRVLRRCGVRSVGSGGARLTCRSFSRARGRSRWYLISTAPLVATSTACRVPCPWGATTVPRFFLGAASMSVRSGGEDARRAAGAARGPEAGAAGARRRRARAGSGTAPGEDWRERRRDGRPGSDASGRPRDPVTKRVRQNQSRYRRRPAAGSLARRPSCPGRRSRSTARSPPPEGLRGRRARRWPRGRWRCGPAARRRSCRPRSRRGCRPRLRRGRARAPPGRGARRGARPRSCRGAGRGSAWWRCARRRSTSSGGAASRRRPGLPSVPWPRRSPRRSKTGSCAPRRSTPPPEDGARRWWRAPRARRPRGAPLPSPPLPPPLTSLLLPPQEAVAGEGPCVAGGARADGRSARWSPRAGDAWSRRRARPRGAAARRRRASPGGRRGGLRWAGRGRRCILSIDPGLRARTASRDPRDPKTAERRLRASRSRKVGARFLVLRVFGREAGGRCCWSSRRSDGGWWRGAPGPWARLAGCADGRPCPRRGPDTWRGPCSSPAAAPRAPPPRPRGRACAARTRAAAGRAPGRRRRARGWPAGSGGWSGSRRSRRSGGRLRCWCRSSWPRTSRSGGRVARARGTGASRRACRRCSRCRRARGTGIRRGSAAAAGGRAAIARWRGRRARGPRAGGGSRRCTWTSRCRRRWWRRAGTRGRGSRCCAAAGSSSWWPRSGPGARSRGCSRHTGKNESGQRLDSVAWRLSERVGLRVYPGSNLESGWSRSRGTGTPVSTQACRNLQDTEAGRFLALVAGHEKLVSAESGRPRWLAAVVWRKNRQGCVAVCPGSSLSARRRPDSAANVGVAAPSFPRPLSQPTSPVTERAPLFFSCVFARCIPYCGRCAPTLHHNRPYRSSSNSRRFCPRPSSSQPLPRRPPAEPAFSMTWPWKRARGWRGWGRRRRSGTRACRKGTLARPTCPSRTCSETGAARSPRRCAPPASTRGGSCGAAWTESGCGTRISRRTSRGSAPRARTWPRPTWSRRTSRPRRRATSKNPSTTTCARSRARRPWACTCGTCWRPSCRTPRASRRRSCFWWCSTVGTTRRSGRRCISPSPRAAGSWTWTFCRASWCRSAGCRCPRSWRPSTSRCVWASTTLGRSTRPRTCPTRRRSTGFTCAPKCPATIWGCTATTGCTARAPAAGASATRSCTACSGPPGPGPRGRATLTWARTCAGSPAAGPWKLPAVPPTWRRWTMRRRRASTWKTDGATVFLLDAATATAAASSRDAGGAAEPAVRHLLGRLDPGHATHHGADDPQSRSLTAASGQPALGHPGGRGALALEPHAREGAGHRERAGGEQGHPRRGRAGVQRAAGARGPLQQHQRADEPGPHGDRRARGGVAARAVPPRVEPGLHGGAERLPEHAARQRAPGPGGLHQLHQRAAADGGRGAPERGVPVGAGLLLPDQSPGLADREPEPGFQELAGTVGRAGPGRGPRDGVEPADAELAPAAAAGGALHGQRQREPRLVPGLPAPVPRGHRTGARGRADLPGDHPREPRAGPGGPGQPGGHPELPADQPVAEDPAPVRAEHRGGAHPALRAAERGAVPDAGGGHAQRGARHDRAQHGAQHVRPQPPVHQADGLLASGGRHELGLLYQRHLEPALAPAARVLHGRVRHARPQRRVPVGRRGQQRVLAASRNQCRVEERGRGPAAVLGAVRSRGCCRGGARGRQPLPEPALFAEQRAQQRAGSADATAPAGRGGVPERLLVEARAREELPQRDREPGGQDEPLEDVRARAQGRAPSQRRHPTPAARQAAGTGVGRGFRRRQQRVGLGWEWWPVRSPAPPYRAPDVRIKNKRRYSPRPWRPACVLLCCLYDEARVPGGSSSLVRERDAAGGGGGDAAPAGGALRAPAVPGAYGGAEQHSLLGAGTLVRYHPVVPGGQQVGRHRLAELPERPQQLPDHRGAEQRFHPHGGQHPDHQLRALAVGRPAENHHAHQHAQRERVHVQQQVQGAGDGLAQDPQRGGLWSGRADLRVGGVAARGQLLGDHDHRSDEQRHHRQLLGGGAAERGAGERHRREVRHAQLPAGLGPRDRAGDAGRVHQRGLPPRHRPAARLRRGLHREPPQQPAGHPQAAALPGGLPDPVRGPGGGQHPRALGCRSLREKQGGHRRGDRSRGHRLYRGAGRFCRCGSGRGGNRKDSHPAGGEGQQGQELQRARGQEKHRLPQLVPGLQLRRPREGRALLDAAHHLGRHLRRGASLLVAARHDARPGHLPLHASSQLPGGGRRAPARLLQELLQRAGRLLAAAARLHLAHARLQPLPREPDPRPPARAHHYHRQKRSCSHRSRDPAAAQQYPGSPARDRHRQTPHLPLRLQGPGRSRAARPLEPHLLKNVHSHLAQHRLGPARAQQDVRRRSPTLHATPRARARALPRSLGRPQGPRALAHHRRRRDRPGGGRRAQLHARRRARLHRGRRHRQRGGRRAPVRPHQEPAAAHRPAAPEHPRHARGASLAAQGQAHGTQGHAQGGQTRGLRQQQRRQDPQTRGHGGGGGHRQHVPPAARQRVLGARRRHRCARARAHPPPSHLKMLTSRCCVPAARRMSKRKYKEEMLQVIAPEIYGPAAAVKEERKPRKLKRVKKDKKEEEDDGLVEFVREFAPRRRVQWRGRKVKPVLRPGTTVVFTPGERSGSASKRSYDEVYGDEDILEQAVERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTSTRRRRKYGAASLLMPNYALHPSIIPTPGYRGTRFYRGYTSSRRRKTTTRRRRRSRRSSTATSALVRRVYRSGREPLTLPRARYHPSIAILPPPTCRYGPHMPPPRPHYGLPRKKAAPKADGERAASPSPPAAARHQQAVGGRLPARADPHHRRGDRGDPRHSFRGGAGLSAPLRHKKAWICNKKKNGLTLLVLCVFLDGRHQFFVPGTATRHAAVYGHLERHRQQPTERGRLQLEQSLERAEFRVHAQNLWQQGVEQQHRAGAEGKAERTELPAEGGWPGLRHQRGGPGQPGRAETDQQPPGRGPARGVRGDAPGGGGAASPGQARRQATASRRGGDAADAHGRAAPVRGGGETGPAHHAARGASGHRSAETQQQPARDPGLASASPLHSGAPAAGGRRVARPPRPPPGELAEHSEQHRGSGSAECEAPPLLLKDTVALNLLVCVYMYVRRPEGGVRGASPSCKMATPSMLPQWAYMHIAGQDASEYLSPGLVQFARATDTYFSLGNKFRNPTVAPTHDVTTDRSQRLTLRFVPVDREDNTYSYKVRYTLAVGDNRVLDMASTYFDIRGVLDRGPSFKPYSGTAYNSLAPKGAPNSSQWEQAKTGNGGTMETHTYGVAPMGGENITKDGLQIGTDVTANQNKPIYADKTFQPEPQVGEENWQETENFYGGRALKKDTNMKPCYGSYARPTNEKGGQAKLKVGDDGVPTKEFDIDLAFFDTPGGTVNGQDEYKADIVMYTENTYLETPDTHVVYKPGKDDASSEINLVQQSMPNRPNYIGFRDNFIGLMYYNSTGNMGVLAGQASQLNAVVDLQDRNTELSYQLLLDSLGDRTRYFSMWNQAVDSYDPDVRIIENHGVEDELPNYCFPLDGSGTNAAYQGVKVKDGQDGDVESEWENDDTVAARNQLCKGNIFAMEINLQANLWRSFLYSNVALYLPDSYKYTPTNVTLPTNTNTYDYMNGRVTPPSLVDAYLNIGARWSLDPMDNVNPFNHHRNAGLRYRSMLLGNGRYVPFHIQVPQKFFAIKSLLLLPGSYTYEWNFRKDVNMILQSSLGNDLRTDGASIAFTSINLYATFFPMAHNTASTLEAMLRNDTNDQSFNDYLSAANMLYPIPANATNVPISIPSRNWAAFRGWSFTRLKTRETPSLGSGFDPYFVYSGSIPYLDGTFYLNHTFKKVSITFDSSVSWPGNDRLLTPNEFEIKRTVDGEGYNVAQCNMTKDWFLVQMLAHYNIGYQGFYVPEGYKDRMYSFFRNFQPMSRQVVDEVNYKDYQAVTLAYQHNNSGFVGYLAPTMRQGQPYPANYPYPLIGKSAVASVTQKKFLCDRVMWRIPFSSNFMSMGALTDLGQNMLYANSAHALDMNFEVDPMDESTLLYVVFEVFDVVRVHQPHRGVIEAVYLRTPFSAGNATTAALASCKMTAGSGEQELRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDMKTGVCMMLYSTAHVYATFSEALTLFRNRRGSAGSRHGPRAGIRCGTGTWAATTRGSAAWARGGRGTSRSTACAVAGRPAGRARRSNRSWDPRSARESCGTRGCSTGTPSGPGASRLPAPSRRCPPRPDPRRWPSRRGSSCRSAAPCWARSRACGCNRSAGGSASSGPARSSCPGTWPSKPPAGGRPAAPCRPRRRPRRTCRTGWWRSRRRARSSARRCWPAAPRCAPSGSGSWPGWGSPSARAARSRSPHPSRCAPSGSSRSRAGTAACPRLRCSRAATARSRCTPSSCGRSGSASARSPAGSGPSSRSGSCCWRSAGCRGAPRSHTGGRCGGTPRPARASAGRRTSGRSPRGTGPSAASSLPCPSPRPKRSAGSGGSSPPLSSSPPPRSGGRSRPGSQTLACRPSRCARGESSPRPPAPPRPAFRPRCPGCLAKAHAWSCGVSFWAAEAAAMCWESASSRSPRLFLLLGRRPRPRGGRHASSGAEAEATGSRGSAGGWQSPFRVRGCAPGGAALTDFLRGRPLCSPREQQQAWRLSHRRQHRHLPPPPPPTRTSSRMKAPPRRPAPPPTPRPQTCKRWRNPSRLTWATRPRSTRRSWQRAFQPRKRTTKSSQSRKQRTSRTRLGTSMATTAGQRTCSSSIWPANASSSRTRCSTAPRCPSAWRSSAAPTSATSSRRACPPSASPTAPVSPTRASTSTRSSRCPRPWPPTTSFSRTKGSPSPAAPTAPAPTPCSTWAPAPAYLISPPWKRFPRSSRVWAATRLGPRTLCKEAERSMSTTAPWWSWKATTRAWRSSSARSSPTSPTRRSTCPPRSAPSWTRCSSSAPRPSRRRRCRTPRVRTRASPWSATSSWRAGWERVAPPRAWKSGASSWPWSWPWSWSVCAASLPTRRPCARSRRTCTTSSGTGSCARPARSPTWSPTWSPTWASCTRTAWGKTCCTPPCAGRPAATTSATASTCTSATPGRRAWACGSSAWRSRTKSSASSCRRTSRPCGPGSTSVPPPRTWPTSSSPSACGRCATGCPTLAKACCKTFALSSSNAPGSCPPPAPRCPRTSCRPSASAPRRSGATATCCAWPTTWPTTRTSRTSAARVCWSATAAATSARRTAPWPATPSCARPRSSAPSSCKAPATARARGVNSPRGCGPRPTCASSCPRTTIPSRSGSTRTNPSRPRPSCRPASSPRGPSWPNCKPSRNPAKNFCKRATGSTWTPRPERSSTPASPRMPRGSSKKLKVELPPPEDLEEDWESSQAEEEEMEDWDSTQAEEDSLQDSLEEEDEVEEAEEEAAAARPSSSAEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQKTSGSSSKIHSGGRWTEDRGERAGADPGAEEPDLSHPLCHLPAESGAGAGTESQEPFSALAHPQLSVSQERRPTSAHSRGRRGSLQQVLRAHSRVARARPHTEKGGNYVTTCALRPTIMSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYDMSHGGAADLARLRHLDHCRRFRCFARDLAEFAYFELPEEHPQGPAHGVRIIVEGGLDSHLLRIFSQRPILVEREQGQTLLTLYCICNHPGLHESLCCLLCTEYNKSDQRLLRTRLWCSCYQPVPVLHRERDRAPAPVAPQEVPHLAVPGLPDRRCQPLRQRRSPAERPCQPYFFHPQKQAPALPTLPPRDLSVRLRTLPSHLPPDPEYHSAAPRYQPNYPPTPPSRPFLIYHYRRWLLLLVLPRPVDPRSPTQSPEEVRKCKFQEPWKFLKCYRQKSDMHPSWIMIIGIVNILACTLISFVIYPCFDFGWNSPEALYLPPEPDTPPQQQPQAHALPPPQPRPQYMPILDYEAEPQRPMLPAISYFNLTGGDDPTGQQRQRPSPGHGRPRLGAATRPTSHSSAAGESRQGAAGRHSHPPVQERHLLPGETGQDLLRGHPDRPSPLLRAPAAAPEVHLPGRSQPHRHHPAVGRYQGVHPLLLRLPRLRPHSDQDPLRPPRPPPHELITPLSSEIKIILMMIIKKIIIFEIKIQSYFEFNKNKESLTNLIPGLCPCFLPTPPHSPLPSSGTAGPGGLQTSSTRRGCQIPPVPQSSFYLLSDVQKARPGGLRPRLPLRCRQRTDRALHQPPLRLFRWIPREAPGGVVPATGPRHHQERGNHPQAGRGGGPRLVGKTHLQHGHQGRRPSQYFKQHHFPNCCPFLQQQWNFKPQCLHTISSISHIHFRHKSWKRSSDFKVVDCTTNSSSYIQLKHHSKNRQRAIYLQWKQRTGYKPKKRTSFRCYCNIYWKWLRLWILWKNKTRNYQNWSRIKFCQSNSCQTRHRFKFLRWCLDSWKQTGQANTLDYPPKPLSITFRQRCQIYSLSYKMRSNTRHCGSGGCYCRISTKSNHSQKRHSFPIFRWCTHVKLINGRLLELGGTDHSKCSLYKCCGIHAKYRCISKNPKNTKHSQSGIFNWRNYYANDTNHNFQWHKRHNPSHLLYDFYMAVDWRLGQKYYLCYQLILFFLHRPGIIPPSKPTPFPTTFVYMETLKQKNKVQVFYINSFTGLEQLFFLHPPRTWNTPPSPPAQPTSECHWWTCFWSPRSTQFQSEPVSDRSGRNPPGTPASAPHSSTAEDCPRWSGSRLSGRSRRAAVGIIVRERDRPVVSHQAPQQSLPPPLRQAAAQGVRVQGLPQHDAHGPQHQSSGAAGAAAHANLAQVTAVRATQDHQVVQQSIVQHAPAETHRGKDATHVAVVPDPQVNQVALPPEDAAHVHDLLGHVAVHHLPVPHHPLVEHAAPDDPAEPQGQHRPARHAAKRPRIPAMTMEDPPLVPVDHLGAEQVYVGTAQAYAHASLQHSQLLGGQNHIPGHGELLQDSEPRRTGQSSHITYIVHGQGIAIRQHRVILHQRSAGLGLLTAWGGRPIRVMAGRGSCSRPCHDAVAFGHFRTCCSRTWSGRCTPIAGGGLGAWNARCSCKTATLSDRAADLGPQERSHHALSHRPPWNGPGPARCNFVGFRRRGREEQEEPLTFNPNGLGALQNEGHGDGTSRPRCVGGKQPGQRYGSRDVPRWLPAKPPRAHPETRQRKREGSLIPQPSCYTPAPSPDNFHFSSLEFELVPEVNPSQPKARAEHPPPAFLSTPSFQDILLLVHLQQIDKRNIKISAAIPELLPQQLVLFHIVSEIFSHRTPRNKRRASHITDKPKSPPVSIAKCKIEISMLARPGDIFQITGQKIGAIFKKINKRKIFQVHVGLGNNDGVSARGAFQHGLADLKNKKNIKPCPGEQVGKSFSPAPGRPRGLRRDPRKNCRYDKPSQRDVPGGRREFEKKHTPPEHWSPVKKSGRGSNEALQRSLSSPAKRCHADEAQNFQVRKKCNYSPPAQAAKLPIPPDTHTKPQRPLTERQQQRHTTGARVREKTELPVRPLSAQYIAPDLHRKGQSLKIPAKSHTPSTRPETGDTLRKIRALPQTAKLPSFPGSHATSSKHDFQIPSTVKNITRPAPNGRRSRSQSPSSLPKFKQLICILTRTKSLRYIIDD

SEQ ID NO: 15 - protein, 11142 aa, Artificial Sequence
  Artificially Synthesized
  misc_feature (2011)..(2011): Xaa can be any naturally occurring amino acid
HHQYTSNFWCALICKAVIWGGRKVIGRETGDRGRGGRFDDVAVRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLRLEYLIRLTIGLRLEFDATMRVMGILRSYQQWWIWGILGFWMLMICNVWGNLWVTVYYGVPVWKEAKTTLFCASDAKAHKEEVHNIWATHACVPTDPNPQEIVLKNVTENFNMWKNDMVDQMHEDIISLWDQSLKPCVKLTPLCVTLNCSDVKIKGTNATYNNATYNNNNTISDMKNCSFNTTTEITDKKKKEYALFYKLDVVALDGKETNSTNSSEYRLINCNTSAVTQACPKVSFDPIPIHYCAPAGYAILKCNNKTFNGTGPCNNVSTVQCTHGIKPVVSTQLLLNGSLAEEEVVIRFENLTNNAKIIIVHLNESVEINCTRPSNNTRKSVRIGPGQTFFATGDIIGDIRQAHCNISRKKWNTTLQRVKEKLKEKFPNKTIQFAPSSGGDLEITTHSFNCRGEFFYCYTSDLFNSTYMSNNTGGANITLQCRIKQIIRMWQGVGQAMYAPPIAGNITCKSNITGLLLTRDGGKEKNDTETFRPGGGDMRDNWRSELYKYKVVEIKPLGIAPDKAKRRVVEREKRAVGIGAVFLGFLGAAGSTMGAASMTLTVQARQLLSGIVQQQSNLLRAIEAQQHMLQLTVWGIKQLQTRVLAIERYLKDQQLLGIWGCSGKLICTTAVPWNASWSNKSYEEIWGNMTWMQWDREINNYTNTIYSLLEESQNQQEKNEKDLLALDSWESLWSWFNITNWLWYIRIFIIIVGGLIGLRIIFAVLSIVNRVRQGYSPLSFQTLTPSPREPDRLGRIEEEGGEQDRARSVRLVNGFLALAWEDLRSLCLFSYHRLRDLILIAARAAALLGRSSLWGLQKGWEALKYLGSLVQYWGLELKKSAISLFDAIAITVAEGTDRIINIVQRISRAFYNIPRRIRQGFEATLQGTSRVDPGGQTADQPRLCLLVASHLLFAPPPCLPPWKVPLPLSFPNKMRKLHRIVVGVILFWGVGWGRTARGRIGKTIAGMLGMRWALWLLRRKEPADLQIIHLCRVRRKRNGIMGIMGLHIGQISICWPPCMPRTPARHGPSSSTTSPDAMCTWGPAEACSCPTSATCNLRCCWSPMPCPEARGCLTMWSCGKFDMMNPRPGAGPANAEASTPGFSPCVWRRRTCDPIIWCCPATGRSSAPAGKNLTRVSSVWGRWRACMRGRMTKICVFLCVAAAAEAPPLREGYSALIRGVSPPGRECVRMWDPRWTAGPCSPRTLQPPTRPAPRPWTQLPPQLLLPPPAPCAEWPWAPATTALWWPTRLPPIIPPATRRSCCCWPSSRPPSAWASPSRWLSCRRRRGPRLPRKPNKKINKTETVVDFNTESIFIFFARGRPWTTGLDHAPGGFFPGPGRGGLGCGTWAARPGGGGSSIAGPRARGWCCKSPSHSRGAGRGAARCPGGDWPRAAPWCRCRTCAGRDACGGRDASWPGSDWRCSRPDPAGGSCCAGPPARCIRRTWGICHATWKGRRERIWRRPCDRPGFPCTHPWRWARGRRPGQRRFGGRTHRSCGPGARHRPFIWGGGCPTGGRRCPRSRGRSCPRRSASPRPARRGGSCPPAGRKKRFPGRGRAGPKAGSGAAGTCRSRWGRRPRPAAGGSGRDSCRPRGGGGPPRSSSRAHACSRARVPPGGARPPARGALAARRSFSAAXRRPWAFWRGSVARVPDGPRARCALGHLDPADLLVSRVGATAGVGHQAMGVQRGQGPVLPGSQGPRQRGLRHGEGVRAGLGACEGALQAHPAGREPLPVGALRVGQVAIEHEFVVERLGRVALGAELTFGSVSADGTEEGLEGVELGGEEDGLGGVGVRAAAGADGLALHEPGEVGPVGVKNEVSSVLFDAFLTSGLHELVSPLGDKEAVRVPVDRLYGPVLERGAAVLVVEEPRPLRDEGPGPGQHEGGHVGGVAVVVHQRVHLLQGMQAHVPLVHIQEGDWLVSVGHVTGGPGRGGIKGGGPLLVLTVFRIAVQERQLLGVFPLEGWHNLGTQVVSFKRGGFDIDGAVGDAFHEPLVHLVRKDDLFVVELGGEGAVEGVGEELGDGAHGLVLFLVGALLGGDVELHVLARHALPFGEDGGELVGHDSDPPAAVVQGDEVHAGGHLAAQGLVGPAEAPALARAEGGQRVQHELVGGVGVHGEDAGQKLGVEVADAGVQIVQRRLPVAHGQRALVGAEGRAPGHGVRERGGVHAADVVDVEGLLEDADVGGVAAPPADAGAHVVVQLVRGREEPRAEVGALRLFGAVDDLAEDGVGVGGDGGPLEDVEVGVGQADRVPDEVGVGVLQLGDELGGDEDVQGAVVEGLLDDVVLELALLLPQLAVEKELFAVLPVLFEGEPVLIGTVRAHHVELVDGLVGAAALLHGEGVSLCGLAQGGVGEGEGVAHHDLEELVLEVEVVAAALLPELEVRALLVGGVGQSESNIVEEDLARAGHEVASDAERLGHLGPVVDDLGGEDDLVEAVDVVPDDVEFHESRAALNVGQLLELVVGELGGVAEPVLLEGPVGDVGVGAEEGSPEIHGQGGLQAVPVLTELLAHGHFFGGDAVEGAGVAVPAVPLELEGEVVGELDERRVPGEFHDQHEGDELLAEGPHPGVGFHIVGEEEPFGARMRADGEELDLLPPVGGMAVDVMEVEMPTARRALVLVFIQASAVLATLHGMHVLHELYLGSFDEEFQWAVERWRLHLVLYYVLAIGVAIVCLDGGHADEPAREAGPDFGSDGSESEDEGAQAGAVQGPETLRSQVSGQRRRAVDLQELFQGAREVQMVLDLHGAVGGDVHGLQGPVPLGRHHRAPFLLGRCFHAGQKRRRGRAPGGRGGSGPGGRGGRGTSAPRAGRFWYCARRRLAATTRRLTSWIRLWVKATGPVSLNLKESSTESISVSLTAACRRISCTSPELSWAISVMNCSISSSRSPRPARSTVAARSLEMRPMSCEKAFMPASFQTRLTTAPSGSRARMTTWARLSSTWRVKTALQRRWRLSVVAMCSVTKKYMIQRRSGISLTSPRASKRSMASKSTAKLKNWELRAETVNSSSRRRMSSAMVARTSRSKAPGGSSSSISSSSTNISSTSSSGGGGGGGALRRRRRTGRRSMKRSMVSPRRRRMVSVTARPSSRGRSVKTPPRISRWPPGGSPLGRERALTMHLINWPVGTPRKDLSVSRSTGSENRTKASSQSQSQGRLSPVSCSSGISGGGRAMLLVMKLKAVLRRRMVARSTRSLGPACWMRRRSAMPQAWSHLARSLSCMSRSTGTSSSPARPCMRVSPNPRWGWTSARSATTRSARMACCIWVRVVWKSSKSTKRWAPVLMVEQLAMTDQLTVWWPGRTSSWYLRREARVSKMSLQVRTRYWYPTRKCGGGWRSGHRSVAGAPGARSSSMRRWPMYLDIQVMPAAVVEARGNSRTRFQMLRSGRKFMVAAVWPVRRAQSWMLTYGQKRKRSAARLRGLEAKRTGWAARVPRFESRIRLEPQLTWYWHSRLDPSLLTKPPGYGGGSFFGLGRWSKTSKRGKRPPAMARCRSLEKESPGLRCGVPRFEPQRSAPAGFRGRGRGCPVVSKTPPADFSSYGASPSFSCVFARCIPYCGRCAPTLHLNRPYRRSSSNSRRFCPRPSSSQPLPRRPPAEPAFSMTWPWKRARGWRGWGRRRRSGTRACRKGTLARPTCPSRTCSETGAARSPRRCAPPASTRGGSCGAAWTESGCGTRISRRTSRGSAPRARTWPRPTWSRRTSRPRRRATSKNPSTTTCARSRARRPWACTCGTCWRPSCRTPRASRRRSCFWWCSTVGTTRRSGRRCISPSPRAAGSWTWTFCRASWCRSAGCRCPRSWRLSTSRCAWASTTLGRSTRPRTCPTRRRSTGFTCAPKCPATIWGCTATTGCTARAPAAGASATRSCTACSGPPGPGPRGRATLTWARTCAGSPAAGPWKLPAVPPTWRRWTMRRRRASTWKTDGATVFLLDAATATASSRDAGGAAEPAVRHLLGRLDPGHATHHGADDPQSRSLTAASGQPALGHPGGRGALALEPHAREGAGHRERAGGEQGHPRRRGRAGVQRAAGARGPLQQHQRADEPGPHGDRRARGGVAARAVPPRVEPGLHGGAERLPEHAARQRAPGPGGLHQLHQRAAADGGRGAPERGVPVGAGLLLPDQSPGLADREPEPGFQELAGTVGRAGPGRGPRDGVEPADAELAPAAAAGGALHGQRQREPRLVPGLPAPVPRGHRAGARGRADLPGDHPREPRAGPGGPGQPGGHPELPADQPVAEDPAPVRAEHRGGAHPALRAAERGAVPDAGGGHAQRRARHDRAQHGAQHVRSQPPVHQADGLLASGGRHELGLLYQRHLEPALAPAARVLHGRVRHARPQRRVPVGRRGQQRVLAAPRHHRVEERGRGPAAVLGAVRSRGCCRGGAGRQPLPEPALFAEQRAQQRAGSADAAAPAGRGGVPERLLVEARAREELPQRDREPGGQDEPLEDVRARAQGRAPSQQRRHPTPATRQAAGSGVGRGFRRRQQRVGLGWEWWWPVRSLAPPYRAPDVRIKNKKRYSPRPWRPACVLLCCLYDEARVPGGSSSLVRERDAAGGGGGDAAPAGGALRAPAVPGAYGGAEQHSLLGAGTLVRYHPVVPGGQQVGGHRLAELPERPQQLPDHRGAEQRFHPHGGQHPDHQLRALAVGRPAENHHAHQHAQRERVHVQQQVQGAGDGLAQDPQWGRGGELWSGRADLRVGGVAARGQLLGDHDHRSDEQRHHRQLLGGGASERGAGERHRREVRHAQLPAGLGPRDRAGDAGRVHQRGLPPRHRPAARLRRGLHREPPQQPAGHPQAAALPGGLPDPVRGPGGGQHPRALGCRSLEKQGGGRRSGDRSRGHRLYRGAGRFCRRGSGRGGNRKDSHPAGGEGQQGQELQRARGQEKHRLPQLVPGLQLRRPREGRALLDAAHHLGRHLRRGASLLVAARHDARPGHLPLHASSQLPGGGRRAPARLLQELLQRAGRLLAAAARLHLAHARLQPLPREPDPRPPARAHHYHRQKRSCSHRSRDPAAAQQYPGSPARDRHRQTPHLPLRLQGPGRSRAARPLEPHLLKNVHSHLAQHRLGPARAQQDVRRRSPTLHATPRARARALPRSLGRPQGPRALAHHRRRRDRPGGGRRAQLHARRRARLHRGRRHRQRGGRCAPVRPRQEPAAAHRPAAPEHPRHARGASLAAQGQAHGTQGHAQGGQTRGLRQQQRRQDPQTRGHGGGGGHRQHVPPAARQRVLGARRRHRCARARAHPPPSHLKMLTSRCCVPAARRMSKRKYKEEMLQVIAPEIYGPAVKEERKPRKLKRVKKDKKEEEDVDGLVEFVREFAPRRRVQWRGRKVKPVLRPGTTVVFTPGERSGSASKRSYDEVYGDEDILEQAVERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTTRRRRKYGAASLLMPNYALHPSIIPTPGYRGTRFYRGYTSSRRKTTTRRRRRRTRRSSTATSAAALVRRVYRSGREPLTLPRARYHPSIAILCRRLLLADMALTCRLRVPITGYRGRKPRRRRLTGNGLRRHHHRRRRAISKRLGGGFLPALIPIIAAAIGAIPGIASVAVQASQRHDTAWKICNKKMDRSWSCDVCFMEDINFSSLAPRHGTRPFMGTWSDIGNSQLNGGAFNWSSLWSGLKNFGSTLKTYGNKAWNSSTGQALREKLKEQNFQQKVVDGLASGINGVVDLANQAVQKQINSRLDAVPPAGSVEMPQVEEELPPLDKRGDKRPRPDAEETLLTHTDEPPPYEEAVKLGLPTTRPVAPLATGVLKPSSSSQPATLDLPPPASRPSTVAKPLPPVAVASRAPRGRPQANWQSTLNSIVGLGVQSVKRRRCYKTLRLTCLSVCICMSADQKEEEARRRVARWPPHRCCPSGRTCTSPDRTLRSTVRVWCSSPAPQTPTSVWGTSLGTPRWRPRTMPPTAASGRCASCPWTARTTPTRTKCATRWPWATTACWTWPAPTLTSAACWIGGPASNPTPAPPTTAWLPRERPTLASGHIKLVILIQKKPIHMEMHLCKALALQRMVFNLELTAMVRQSMQTKLINQSLKWVMLNGMTSLVLMKNMEAELLSLTPKSLAMVLLPSLPIKKEARQMKPKQAVPKNMTLTWHSSIIEVQLPPAPQKLFCILRMWIWKLQIPILYTRQVQMTVALLSIWVSSPCPTDPTTLASETTLSVCTTTALAIWVYWLDRPPSMLWWTCRTETPNCPTSSCLTLWVTEPGISVCGIRRWTVMTPMCALLKITVWRMNFLTIASPWMLWVELILTRELRPMVIIKPPGPKMILLMMLMNWARAILSPWRSTSRPTCGGTSSTRTWRCTCPTPTSTRRPTSRCPPTPTPTITTAAWWRPRWWTPTSTSGRAGRWTPWTTSTPSTTTATRACDTAPCSWATGATCPSTSRCPKSFSPSRASCSCPGPTPTSGTSARTSTSCRAPSATTCARTGPPSPSPASTSTPPSSPWRTTPPPRSRPCCATTPTTSPSTTTSRRPTCSTPSRPTPPTCPSPSPRATGPPSAAGPSRASRPARRPRSAPGSTPTSSTRAPSPTSTAPSTSTTPSRRSPSPSTPPSAGPATTASRPTSSKSSAPSTERGTTWPSATPRTGSWSRCWPTTTSATRASTCPRATRTACTPSSATSSPAARSWTRSTTRTTRPSPWPTSTTTRASSATSRPPCARASPTPPTTPTRSSARAPSPASPRKSSSATGSCGASPSPATSCPWARSPTSARTCSTPTPPTRTISKSTPWMSPPFSMLSSKSSTSSECTSPTAASSRPSTCARPSRPATPPPKPLASCKMTACAGSGEQELRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDMSGVCMMLYSSTAHVYATFSEALTLFRNRRGSAGSRHGPRAGIRCGTGTWAATTRGSAASARGGRGTSRSTACAVAGRPAGRARRSNRSWDPRSARESYGTRGCSTGTPSGPGASRSPAPSRRCPPRPDPRRWPSRRGSSCRSAAPCWARSRACGCNRSAGGSASSGPARSSCPGTWPSKPPAGGRPAAPCRPRRRPRRTCRTGWWRSQRRARSSARRCWPAAPRCAPSGSGSWPGRGSPSARAARSRSPHPSRSCAPSGSSRSRAGTAACPRPRCTRAATARSRCSPSSCGRSGSASARSPAGSGPSSWSGSCCWRSAECRGAPRSHTGGRYGGTPRPARASAGRRTSGRSPRGTGPSAASSLPCPSPRPKRSAGSGGSSPLSSSPPPKSGGRSRPGSQTLACRPSRCARGESSPRPPAPPRPAFRPRCPGCLAKAHAWSCGVSFWAAEAAAETCWASASSRSPRLFLLLGRRPRPRGGRHASSGAEAEATGSRGSAGGWQSPFRVRGCAPGGAALTDFLRGRPLCSPREQAWRLSHRRQHRHLPPPPPTRTSSSRMKAPPRRPAPPPTPQPQTCKRWRNPSRLTWATRPRSTRRSWQRAFQPRKRTTKSSQSRKQRASRTRLGSSMATTAGQRTCSSSIWPANASSSRTRCSTAPRCPSAWRSSAAPTSATSSRRACPPSASPTAPASPTRASTSTRSSRCPRPWPPTTSFSRTKGSPSPAAPTAPAPTPCSTWAPAPAYLISPPWKRFPRSSRVWAATRLGPRTLCKEAERSMSTTAPWWSWKATTRAWRSSSARSSPTSPTRRSTCPPRSAPSWTRCSSSAPRPSRRRRCRTPRARTRASPWSATSSWRAGWERVAPPRAWKSGASSWPWSWPWSWSVCAASSPTRRPCARSRRTCTTSSDTGSCARPARSPTWSPTWSPTWASCTRTAWGRTCCTPPCAGRPAATTSATASTCTSATPGRRAWACGSSAWRSRTKSSASSCRRTSRPCGPGSTSAPPPRTWPTSSSPSACGRCATGCPTLAKACCKTFALSSSNAPGSCPPPAPRCPRTSCRPSASAPRRSGATATCCAWPTTWPTTRTSRTSAARACSSATAAATSARRTAPWPATPSCARPRSSAPSSCKAPARARGVNSPRGCGPRPTCASSCPRTTIPSRSGSTRTNPSRPRPSCRPASSPRGPSWPNCKPSRNPAKNFCKRATGSTWTPRPERSSTPASPRMPRGSSKKLKVELPPPPEDLEEDWESSQAEEEEMEDWDSTQAEEDSLQDSLEEEDEVEEAEEEAAAARPSSSAEEEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQQQQKTSGSSKIHSGGRWTEDRGERAGADPGAEEPDLSHPLCHLPAESGARAGTESQEPFSALAHPQLSVSQERRPTSAHSRGRRGSLQQVLRAHSRVARARPHTEKGGNYVTTCALRPTIIMSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYDMSHGGAADLARLRHLDHCRRFRCFARDLAEFAYFELPEEHPQGPAHGVRIVVEGGLDSHLLRIFSQRPILAEREQGQTLLTLYCICNHPGLHESLCCLLCTEYNKSDQRLLRTSVCSCYQPVPVLHRERDRAPAPVAPQEVPHLAVPGLSDRRCQPLRQRRSPAERPCQPYFFHPQKQAPALPTLPPRDLSVRLGTLPSHLPPDPEYHSVAPRYQPNYPPTPPSRPRTCTELEKYATIHAHIRLGRATATHAPRYLLQSNRRRLTHWPTTTSTTFSWTWTAAPRSSDSPNFAFASSRREPSRSCRTAPSTSARKASSAWNRPRSPTRSPRPTIASPTSSCSSARSSPAWSESTPSSSPSSRAIPRGASTAPATPPTASTLSRPSAASATSSPTNHPLIQNKYHIDDDLNKKSFDLKRYNHIDDLSFKKRITYLKSDTRSLSMFSANTTSLPSSQLWYCRPRRAANFLHTLKGMSNSSCPSIFILSSIRCPKSASGWMMTSTPSTPTMQTTHRPCPSSTPPSSLQMDSKRSPWGCCPCDWLTPSPPRTGKSPSSWERGWTSTPRENSSPTRPPRPPPLSVFPTTPFPLTWIPLFIPKMENYPYKFLHRTYNQPFTHLLMDQVDVVALLLQYSWPLHSLLMKKEILKLTPVVHQLMQVDLVSTAKEGSLSLPQEMQLKATAGLKVDLKVMALQTLAEDWNLEPLVQRLMSQMHTQFKLNWVLALPLTVQAPLLLGTKRMINLHYGPQPTPRQIAKYTLKKMPNSHFAQSVEVKFWVLLYWQIMEVSTQSQTQALHSSPSSLMQVEFCAAPHTKNIGTSEREMLHLLSPILMLVLCLTRPILKTHLQLQKAILSVKFISMGMRPNHCLLLLMKLRMQLAPTVSLFNGNGIVLSTQVKHLLPAPSPSPTSPKNEHCIPPCMPTLPTPLCLWKKLSTKNKVQVFYFNSFTGFEQLFFLHPPRTWNTPPSPPAQPTSECHWWTCFWSPRSTQFQSEPVSGRSGRNPPGTPASAPHSSTAEDCPRWSGSRLSGRSRRAAVGIIVRERDRPVVSHQAPQQSLPPPLRQAAAQGVRVQGLPQHDAHGPQHQSSGAAGAAAHADLAQVAAVRATQDHQVVQQSIVQHAPAETHRGKDATHVAVVPDPQVNQVALPPEHAAHVHDLLGHVAVHHLPVPHHPLVEHAAPDDPAEPQGQHRPARHAAKRPRVPAMAMEDPPLVPVDHLGAEQVYVGTAQAYAHASLQHSQLLGGQNHIPGHGELLQDSEPRRTGQSSHITYIVHGQGIAIRQHRVILHQRSAGLGLLTAWGGRPIRVMAGRGSCSRPCHDAVAFGHFRTCCSRTWSGRCTPIAGGGPGAWNARCNCKTATLSDRAADLGPQERSHHALSHRPPWNGPDPARCNFVGFRRRGREEQEEPLTFNPNGLGALQNEGRGDGTSRPRCVGGKQPGQRYGSRDVPRWLPAKPPRAHPETRQRKREGSLIPQSSCYTPAPSPDNFHFSSLEFELVPEVNPSQPRARAERPPPAFLSTPSFQDILLLVHLQQIDKRNIKISAAIPKLLPQQLVLFHILSEIFSHRTTRNKIRASHSTDKPKSSPVSIAKCKTAISMLARPGDIFQITGQKITQAIFKKINKRKILQVHVSLGNNDEVNASGAFQHGLADLKTKNKTLNHASLANRWVNRSLQHQAGHGVSGATLVKIVAMIENHHRETFPVAGVNDSTRIHPRNIGVREKKAPEEAIRHYNAQSQVQQSDAMRMKHKILRCVQNVITPLLHRQRSPRSLQIHIQSLSVHSLPSSSTQQAQESEKGALTCPPALCSIYSPDLHRKGQSLKIPAKSHTPSTRPETGDTLKKIRALPQTPKLPSFPGSHATSSEFDFQIPSTVKNVTRPAPNGRPSLGQSPSSLPKFKQLICILTRTKSLRYIIDD

SEQ ID NO: 16 - protein, 11128 aa, Artificial Sequence
  Artificially Synthesized
  misc_feature (1997)..(1997): Xaa can be any naturally occurring amino acid
HHQYTSNFWCALICKAVIWGGRKVIGRETGDRGRGGRFDDVAVRRSRFASSRGKSDVKRGVVTRKYSIFPRSLTGNEVFLGGCKKRAIFARKLNEEVKIVISRLWQGGVFAEGRVDFDRLRGGFDYRIFHLNFRVRCQSPVFLRTISFPRKCHLTVTITVLRRKLRSPDPLWCTLSTICSDAALSQYLLPACVLEVAECASKIATTRQGLTDNCMKNLLRVRRFALLRDVRARYTRHLLTSMPSTPPIDVNDGKWPAWHYAQYMTLWDFPTWQYIYVLVIAITMVMRFWQYINGRGRFDSRGFPSLHPIDVNGSLFWHQNQRDFPKCRNNSAPLTQMGGRRVRWEVYISRARLVNRQITRSFIAVVYHSIANAVSASDTTVSNLRLEFDATMRVRGIPRNWPQWWIWGILGFWMIIICRVVGNLDLWVTVYYGVPVWKEAKTTLFCASDAKAYDKEVHNVWATHACVPTDPNPQEIVLENVTENFNMWKNDMVDQMHEDIISLWDQSLKPCVKLTPLCVTLNCKNVNISANANATATLNSSMNGEIKNCSFNTTTELRDKKQKVYALFYKPDVVPLNGGEHNETGEYILINCNSSTITQACPKVSFDPIPIHYCAPAGYAILKCNNKTFNGTGPCNNVSTVQCTHGIKPVVSTQLLLNGSLAEEEIIVRSENLTNNIKTIIVHLNKSVEIKCTRPNNNTRKSVRIGPGQTFYATGEIIGDIREAHCNISRETWNSTLIQVKEKLREHYNKTIKFEPSSGGDLEVTTHSFNCRGEFFYCDTTKLFNETKLFNESEYVDNKTIILPCRIKQIINMWQEVGRAMYAPPIEGNITCKSNITGLLLTWDGGENSTEGVFRPGGGNMKDNWRSELYKYKVVEIKPLGVAPTKSKRKVVGREKRAVGLGAVLLGFLGAAGSTMGAASITLTVQARQLLSGIVQQQSNLLRAIEAQQHLLQLTVWGIKQLQTRVLAIERYLKDQQLLGLWGCSGKLICATAVPWNSSWSNKSLGDIWDNMTWMQWDREISNYTNTIFRLLEDSQNQQEKNEKDLLALDSWKNLWNWFDITNWLWYIKIFIMIVGGLIGLRIIFGVLAIVKRVRQGYSPLSFQTLIPNPRGPDRLGRIEEEGGEQDKDRSIRLVSGFLALAWDDLRSLCLFSYHQLRDFILTAARAAELLGRSSLRGLQRGWEVLKYLGNLVQYWGLELKRSAINLFDTIAIAVAEGTDRIIEVIQRICRAIRYIPTRIRQGFEAALLGTSRVDPGGQTADQPRLCLLVASHLLFAPPPCLPPWKVPLPLSFPNKMRKLHRIVVGVILFWGVGWGRTARGRIGKTIAGMLGMRWALWLLRRKEPADLQIIHLCRVRRKRNGIMGIMGLHIGQISICWPPCMPRTPARHGPSSSTTSPDAMCTWGPAEACSCPTSATCNLRCCWSPMPCPEARGCLTMWSCGKFDMMNPRPGAGPANAEASTPGFSPCVWRRRTCDPIIWCCPATGRSSAPAGKNLTRVSSVWGRWRACMRGRMTKICVFLCVAAAAEAPPLREGYSALIRGVSPPGRECVRMWDPRWTAGPCSPRTLQPPTRPAPRPWTQLPPQLLLPPPAPCAEWPWAPATTALWWPTRLPPIIPPATRRSCCCWPSSRPPSAWASPSRWLSCRRRRGPRLPRKPNKKINKTETVVDFNTESIFIFFARGRPWTTGLDHAPGGFFPGPGRGGLGCGTWAARPGGGGSSIAGPRARGWCCKSPSHSRGAGRGAARCPGGDWPRAAPWCRCRTCAGRDACGGRDASWPGSDWRCSRPDPAGGSCCAGPPARCIRRTWGICHATWKGRRERIWRRPCDRPGFPCTHPWRWARGRRPGQRRFGGRTHRSCGPGARHRPFIWGGGCPTGGRRCPRSRGRSCPRRSASPRPARRGGSCPPAGRKKRFPGRGRAGPKAGSGAAGTCRSRWGRRPRPAAGGSGRDSCRPRGGGGPPRSSSRAHACSRARVPPGGARPPARGALAARRSFSAAXRRPWAFWRGSVARVPDGPRARCALGHLDPADLLVSRVGATAGVGHQAMGVQRGQGPVLPGSQGPRQRGLRHGEGVRAGLGACEGALQAHPAGREPLPVGALRVGQVAIEHEFVVERLGRVALGAELTFGSVSADGTEEGLEGVELGGEEDGLGGVGVRAAAGADGLALHEPGEVGPVGVKNEVSSVLFDAFLTSGLHELVSPLGDKEAVRVPVDRLYGPVLERGAAVLVVEEPRPLRDEGPGPGQHEGGHVGGVAVVVHQRVHLLQGMQAHVPLVHIQEGDWLVSVGHVTGGPGRGGIKGGGPLLVLTVFRIAVQERQLLGVFPLEGWHNLGTQVVSFKRGGFDIDGAVGDAFHEPLVHLVRKDDLFVVELGGEGAVEGVGEELGDGAHGLVLFLVGALLGGDVELHVLARHALPFGEDGGELVGHDSDPPAAVVQGDEVHAGGHLAAQGLVGPAEAPALARAEGGQRVQHELVGGVGVHGEDAGQKLGVEVADAGVQIVQRRLPVAHGQRALVGAEGRAPGHGVRERGGVHAADVVDVEGLLEDADVGGVAAPPADAGAHVVVQLVRGREEPRAEVGALRLFGAVDDLAEDGVGVGGDGGPLEDVEVGVGQADRVPDEVGVGVLQLGDELGGDEDVQGAVVEGLLDDVVLELALLLPQLAVEKELFAVLPVLFEGEPVLIGTVRAHHVELVDGLVGAAALLHGEGVSLCGLAQGGVGEGEGVAHHDLEELVLEVEVVAAALLPELEVRALLVGGVGQSESNIVEEDLARAGHEVASDAERLGHLGPVVDDLGGEDDLVEAVDVVPDDVEFHESRAALNVGQLLELVVGELGGVAEPVLLEGPVGDVGVGAEEGSPEIHGQGGLQAVPVLTELLAHGHFFGGDAVEGAGVAVPAVPLELEGEVVGELDERRVPGEFHDQHEGDELLAEGPHPGVGFHIVGEEEPFGARMRADGEELDLLPPVGGMAVDVMEVEMPTARRALVLVFIQASAVLATLHGMHVLHELYLGSFDEEFQWAVERWRLHLVLYYVLAIGVAIVCLDGGHADEPAREAGPDFGSDGSESEDEGAQAGAVQGPETLRSQVSGQRRRAVDLQELFQGAREVQMVLDLHGAVGGDVHGLQGPVPLGRHHRAPFLLGRCFHAGQKRRRGRAPGGRGGSGPGGRGGRGTSAPRAGRFWYCARRRLAATTRRLTSWIRLWVKATGPVSLNLKESSTESISVSLTAACRRISCTSPELSWAISVMNCSISSSRSPRPARSTVAARSLEMRPMSCEKAFMPASFQTRLTTAPSGSRARMTTWARLSSTWRVKTALQRRWRLSVVAMCSVTKKYMIQRRSGISLTSPRASKRSMASKSTAKLKNWELRAETVNSSSRRRMSSAMVARTSRSKAPGGSSSSISSSSTNISSTSSSGGGGGGGALRRRRRTGRRSMKRSMVSPRRRRMVSVTARPSSRGRSVKTPPRISRWPPGGSPLGRERALTMHLINWPVGTPRKDLSVSRSTGSENRTKASSQSQSQGRLSPVSCSSGISGGGRAMLLVMKLKAVLRRRMVARSTRSLGPACWMRRRSAMPQAWSHLARSLSCMSRSTGTSSSPARPCMRVSPNPRWGWTSARSATTRSARMACCIWVRVVWKSSKSTKRWAPVLMVEQLAMTDQLTVWWPGRTSSWYLRREARVSKMSLQVRTRYWYPTRKCGGGWRSGHRSVAGAPGARSSSMRRWPMYLDIQVMPAAVVEARGNSRTRFQMLRSGRKFMVAAVWPVRRAQSWMLTYGQKRKRSAARLRGLEAKRTGWAARVPRFESRIRLEPQLTWYWHSRLDPSLLTKPPGYGGGSFFGLGRWSKTSKRGKRPPAMARCRSLEKESPGLRCGVPRFEPQRSAPAGFRGRGRGCPVVSKTPPADFSSYGASPSFSCVFARCIPYCGRCAPTLHLNRPYRRSSSNSRRFCPRPSSSQPLPRRPPAEPAFSMTWPWKRARGWRGWGRRRRSGTRACRKGTLARPTCPSRTCSETGAARSPRRCAPPASTRGGSCGAAWTESGCGTRISRRTSRGSAPRARTWPRPTWSRRTSRPRRRATSKNPSTTTCARSRARRPWACTCGTCWRPSCRTPRASRRRSCFWWCSTVGTTRRSGRRCISPSPRAAGSWTWTFCRASWCRSAGCRCPRSWRLSTSRCAWASTTLGRSTRPRTCPTRRRSTGFTCAPKCPATIWGCTATTGCTARAPAAGASATRSCTACSGPPGPGPRGRATLTWARTCAGSPAAGPWKLPAVPPTWRRWTMRRRRASTWKTDGATVFLLDAATATASSRDAGGAAEPAVRHLLGRLDPGHATHHGADDPQSRSLTAASGQPALGHPGGRGALALEPHAREGAGHRERAGGEQGHPRRRGRAGVQRAAGARGPLQQHQRADEPGPHGDRRARGGVAARAVPPRVEPGLHGGAERLPEHAARQRAPGPGGLHQLHQRAAADGGRGAPERGVPVGAGLLLPDQSPGLADREPEPGFQELAGTVGRAGPGRGPRDGVEPADAELAPAAAAGGALHGQRQREPRLVPGLPAPVPRGHRAGARGRADLPGDHPREPRAGPGGPGQPGGHPELPADQPVAEDPAPVRAEHRGGAHPALRAAERGAVPDAGGGHAQRRARHDRAQHGAQHVRSQPPVHQADGLLASGGRHELGLLYQRHLEPALAPAARVLHGRVRHARPQRRVPVGRRGQQRVLAAPRHHRVEERGRGPAAVLGAVRSRGCCRGGAGRQPLPEPALFAEQRAQQRAGSADAAAPAGRGGVPERLLVEARAREELPQRDREPGGQDEPLEDVRARAQGRAPSQQRRHPTPATRQAAGSGVGRGFRRRQQRVGLGWEWWWPVRSLAPPYRAPDVRIKNKKRYSPRPWRPACVLLCCLYDEARVPGGSSSLVRERDAAGGGGGDAAPAGGALRAPAVPGAYGGAEQHSLLGAGTLVRYHPVVPGGQQVGGHRLAELPERPQQLPDHRGAEQRFHPHGGQHPDHQLRALAVGRPAENHHAHQHAQRERVHVQQQVQGAGDGLAQDPQWGRGGELWSGRADLRVGGVAARGQLLGDHDHRSDEQRHHRQLLGGGASERGAGERHRREVRHAQLPAGLGPRDRAGDAGRVHQRGLPPRHRPAARLRRGLHREPPQQPAGHPQAAALPGGLPDPVRGPGGGQHPRALGCRSLEKQGGGRRSGDRSRGHRLYRGAGRFCRRGSGRGGNRKDSHPAGGEGQQGQELQRARGQEKHRLPQLVPGLQLRRPREGRALLDAAHHLGRHLRRGASLLVAARHDARPGHLPLHASSQLPGGGRRAPARLLQELLQRAGRLLAAAARLHLAHARLQPLPREPDPRPPARAHHYHRQKRSCSHRSRDPAAAQQYPGSPARDRHRQTPHLPLRLQGPGRSRAARPLEPHLLKNVHSHLAQHRLGPARAQQDVRRRSPTLHATPRARARALPRSLGRPQGPRALAHHRRRRDRPGGGRRAQLHARRRARLHRGRRHRQRGGRCAPVRPRQEPAAAHRPAAPEHPRHARGASLAAQGQAHGTQGHAQGGQTRGLRQQQRRQDPQTRGHGGGGGHRQHVPPAARQRVLGARRRHRCARARAHPPPSHLKMLTSRCCVPAARRMSKRKYKEEMLQVIAPEIYGPAVKEERKPRKLKRVKKDKKEEEDVDGLVEFVREFAPRRRVQWRGRKVKPVLRPGTTVVFTPGERSGSASKRSYDEVYGDEDILEQAVERLGEFAYGKRSRPAPLKEEAVSIPLDHGNPTPSLKPVTLQQVLPSAAPRRGFKREGGEDLYPTMQLMVPKRQKLEDVLEHMKVDPEVQPEVKVRPIKQVAPGLGVQTVDIKIPTEPMETQTEPVKPSTSTMEVQTDPWMPAPASTTRRRRKYGAASLLMPNYALHPSIIPTPGYRGTRFYRGYTSSRRKTTTRRRRRRTRRSSTATSAAALVRRVYRSGREPLTLPRARYHPSIAILCRRLLLADMALTCRLRVPITGYRGRKPRRRRLTGNGLRRHHHRRRRAISKRLGGGFLPALIPIIAAAIGAIPGIASVAVQASQRHDTAWKICNKKMDRSWSCDVCFMEDINFSSLAPRHGTRPFMGTWSDIGNSQLNGGAFNWSSLWSGLKNFGSTLKTYGNKAWNSSTGQALREKLKEQNFQQKVVDGLASGINGVVDLANQAVQKQINSRLDAVPPAGSVEMPQVEEELPPLDKRGDKRPRPDAEETLLTHTDEPPPYEEAVKLGLPTTRPVAPLATGVLKPSSSSQPATLDLPPPASRPSTVAKPLPPVAVASRAPRGRPQANWQSTLNSIVGLGVQSVKRRRCYKTLRLTCLSVCICMSADQKEEEARRRVARWPPHRCCPSGRTCTSPDRTLRSTVRVWCSSPAPQTPTSVWGTSLGTPRWRPRTMPPTAASGRCASCPWTARTTPTRTKCATRWPWATTACWTWPAPTLTSAACWIGGPASNPTPAPPTTAWLPRERPTLASGHIKLVILIQKKPIHMEMHLCKALALQRMVFNLELTAMVRQSMQTKLINQSLKWVMLNGMTSLVLMKNMEAELLSLTPKSLAMVLLPSLPIKKEARQMKPKQAVPKNMTLTWHSSIIEVQLPPAPQKLFCILRMWIWKLQIPILYTRQVQMTVALLSIWVSSPCPTDPTTLASETTLSVCTTTALAIWVYWLDRPPSMLWWTCRTETPNCPTSSCLTLWVTEPGISVCGIRRWTVMTPMCALLKITVWRMNFLTIASPWMLWVELILTRELRPMVIIKPPGPKMILLMMLMNWARAILSPWRSTSRPTCGGTSSTRTWRCTCPTPTSTRRPTSRCPPTPTPTITTAAWWRPRWWTPTSTSGRAGRWTPWTTSTPSTTTATRACDTAPCSWATGATCPSTSRCPKSFSPSRASCSCPGPTPTSGTSARTSTSCRAPSATTCARTGPPSPSPASTSTPPSSPWRTTPPPRSRPCCATTPTTSPSTTTSRRPTCSTPSRPTPPTCPSPSPRATGPPSAAGPSRASRPARRPRSAPGSTPTSSTRAPSPTSTAPSTSTTPSRRSPSPSTPPSAGPATTASRPTSSKSSAPSTERGTTWPSATPRTGSWSRCWPTTTSATRASTCPRATRTACTPSSATSSPAARSWTRSTTRTTRPSPWPTSTTTRASSATSRPPCARASPTPPTTPTRSSARAPSPASPRKSSSATGSCGASPSPATSCPWARSPTSARTCSTPTPPTRTISKSTPWMSPPFSMLSSKSSTSSECTSPTAASSRPSTCARPSRPATPPPKPLASCKMTACAGSGEQELRAILRDLGCGPCFLGTFDKRFPGFMAPHKLACAIVNTAGRETGGEHWLAFAWNPRSHTCYLFDPFGFSDERLKQIYQFEYEGLLRRSALATEDRCVTLEKSTQTVQGPRSAACGLFCCMFLHAFVHWPDRPMDKNPTMNLLTGVPNGMLQSPQVEPTLRRNQEALYRFLNAHSAYFRSHRARIEKATAFDRMNQDMSGVCMMLYSSTAHVYATFSEALTLFRNRRGSAGSRHGPRAGIRCGTGTWAATTRGSAASARGGRGTSRSTACAVAGRPAGRARRSNRSWDPRSARESYGTRGCSTGTPSGPGASRSPAPSRRCPPRPDPRRWPSRRGSSCRSAAPCWARSRACGCNRSAGGSASSGPARSSCPGTWPSKPPAGGRPAAPCRPRRRPRRTCRTGWWRSQRRARSSARRCWPAAPRCAPSGSGSWPGRGSPSARAARSRSPHPSRSCAPSGSSRSRAGTAACPRPRCTRAATARSRCSPSSCGRSGSASARSPAGSGPSSWSGSCCWRSAECRGAPRSHTGGRYGGTPRPARASAGRRTSGRSPRGTGPSAASSLPCPSPRPKRSAGSGGSSPLSSSPPPKSGGRSRPGSQTLACRPSRCARGESSPRPPAPPRPAFRPRCPGCLAKAHAWSCGVSFWAAEAAAETCWASASSRSPRLFLLLGRRPRPRGGRHASSGAEAEATGSRGSAGGWQSPFRVRGCAPGGAALTDFLRGRPLCSPREQAWRLSHRRQHRHLPPPPPTRTSSSRMKAPPRRPAPPPTPQPQTCKRWRNPSRLTWATRPRSTRRSWQRAFQPRKRTTKSSQSRKQRASRTRLGSSMATTAGQRTCSSSIWPANASSSRTRCSTAPRCPSAWRSSAAPTSATSSRRACPPSASPTAPASPTRASTSTRSSRCPRPWPPTTSFSRTKGSPSPAAPTAPAPTPCSTWAPAPAYLISPPWKRFPRSSRVWAATRLGPRTLCKEAERSMSTTAPWWSWKATTRAWRSSSARSSPTSPTRRSTCPPRSAPSWTRCSSSAPRPSRRRRCRTPRARTRASPWSATSSWRAGWERVAPPRAWKSGASSWPWSWPWSWSVCAASSPTRRPCARSRRTCTTSSDTGSCARPARSPTWSPTWSPTWASCTRTAWGRTCCTPPCAGRPAATTSATASTCTSATPGRRAWACGSSAWRSRTKSSASSCRRTSRPCGPGSTSAPPPRTWPTSSSPSACGRCATGCPTLAKACCKTFALSSSNAPGSCPPPAPRCPRTSCRPSASAPRRSGATATCCAWPTTWPTTRTSRTSAARACSSATAAATSARRTAPWPATPSCARPRSSAPSSCKAPARARGVNSPRGCGPRPTCASSCPRTTIPSRSGSTRTNPSRPRPSCRPASSPRGPSWPNCKPSRNPAKNFCKRATGSTWTPRPERSSTPASPRMPRGSSKKLKVELPPPPEDLEEDWESSQAEEEEMEDWDSTQAEEDSLQDSLEEEDEVEEAEEEAAAARPSSSAEEEKASSTDTISAPGRGRGGRAHSRWDETGRFPNPTTQTGKKERQGYKSWRGHKNAIVSCLQACGGNISFTRRYLLFHRGVNFPRNILHYYRHLHSPYYCFQEEAETQQQQQQQKTSGSSKIHSGGRWTEDRGERAGADPGAEEPDLSHPLCHLPAESGARAGTESQEPFSALAHPQLSVSQERRPTSAHSRGRRGSLQQVLRAHSRVARARPHTEKGGNYVTTCALRPTIIMSKEIPTPYMWSYQPQMGLAAGAAQDYSTRMNWLSAGPAMISRVNDIRAHRNQILLEQSAITATPRHHLNPRNWPAALVYQEIPQPTTVLLPRDAQAEVQLTNSGVQLAGGAALCRHRPAQGIKRLVIRGRGTQLNDEVVSSSLGLRPDGVFQLAGSGRSSFTPRQAVLTLESSSSQPRSGGIGTLQFVEEFTPSVYFNPFSGSPGHYPDEFIPNFDAISESVDGYDMSHGGAADLARLRHLDHCRRFRCFARDLAEFAYFELPEEHPQGPAHGVRIVVEGGLDSHLLRIFSQRPILAEREQGQTLLTLYCICNHPGLHESLCCLLCTEYNKSDQRLLRTSVCSCYQPVPVLHRERDRAPAPVAPQEVPHLAVPGLSDRRCQPLRQRRSPAERPCQPYFFHPQKQAPALPTLPPRDLSVRLGTLPSHLPPDPEYHSVAPRYQPNYPPTPPSRPRTCTELEKYATIHAHIRLGRATATHAPRYLLQSNRRRLTHWPTTTSTTFSWTWTAAPRSSDSPNFAFASSRREPSRSCRTAPSTSARKASSAWNRPRSPTRSPRPTIASPTSSCSSARSSPAWSESTPSSSPSSRAIPRGASTAPATPPTASTLSRPSAASATSSPTNHPLIQNKYHIDDDLNKKSFDLKRYNHIDDLSFKKRITYLKSDTRSLSMFSANTTSLPSSQLWYCRPRRAANFLHTLKGMSNSSCPSIFILSSIRCPKSASGWMMTSTPSTPTMQTTHRPCPSSTPPSSLQMDSKRSPWGCCPCDWLTPSPPRTGKSPSSWERGWTSTPRENSSPTRPPRPPPLSVFPTTPFPLTWIPLFIPKMENYPYKFLHRTYNQPFTHLLMDQVDVVALLLQYSWPLHSLLMKKEILKLTPVVHQLMQVDLVSTAKEGSLSLPQEMQLKATAGLKVDLKVMALQTLAEDWNLEPLVQRLMSQMHTQFKLNWVLALPLTVQAPLLLGTKRMINLHYGPQPTPRQIAKYTLKKMPNSHFAQSVEVKFWVLLYWQIMEVSTQSQTQALHSSPSSLMQVEFCAAPHTKNIGTSEREMLHLLSPILMLVLCLTRPILKTHLQLQKAILSVKFISMGMRPNHCLLLLMKLRMQLAPTVSLFNGNGIVLSTQVKHLLPAPSPSPTSPKNEHCIPPCMPTLPTPLCLWKKLSTKNKVQVFYFNSFTGFEQLFFLHPPRTWNTPPSPPAQPTSECHWWTCFWSPRSTQFQSEPVSGRSGRNPPGTPASAPHSSTAEDCPRWSGSRLSGRSRRAAVGIIVRERDRPVVSHQAPQQSLPPPLRQAAAQGVRVQGLPQHDAHGPQHQSSGAAGAAAHADLAQVAAVRATQDHQVVQQSIVQHAPAETHRGKDATHVAVVPDPQVNQVALPPEHAAHVHDLLGHVAVHHLPVPHHPLVEHAAPDDPAEPQGQHRPARHAAKRPRVPAMAMEDPPLVPVDHLGAEQVYVGTAQAYAHASLQHSQLLGGQNHIPGHGELLQDSEPRRTGQSSHITYIVHGQGIAIRQHRVILHQRSAGLGLLTAWGGRPIRVMAGRGSCSRPCHDAVAFGHFRTCCSRTWSGRCTPIAGGGPGAWNARCNCKTATLSDRAADLGPQERSHHALSHRPPWNGPDPARCNFVGFRRRGREEQEEPLTFNPNGLGALQNEGRGDGTSRPRCVGGKQPGQRYGSRDVPRWLPAKPPRAHPETRQRKREGSLIPQSSCYTPAPSPDNFHFSSLEFELVPEVNPSQPRARAERPPPAFLSTPSFQDILLLVHLQQIDKRNIKISAAIPKLLPQQLVLFHILSEIFSHRTTRNKIRASHSTDKPKSSPVSIAKCKTAISMLARPGDIFQITGQKITQAIFKKINKRKILQVHVSLGNNDEVNASGAFQHGLADLKTKNKTLNHASLANRWVNRSLQHQAGHGVSGATLVKIVAMIENHHRETFPVAGVNDSTRIHPRNIGVREKKAPEEAIRHYNAQSQVQQSDAMRMKHKILRCVQNVITPLLHRQRSPRSLQIHIQSLSVHSLPSSSTQQAQESEKGALTCPPALCSIYSPDLHRKGQSLKIPAKSHTPSTRPETGDTLKKIRALPQTPKLPSFPGSHATSSEFDFQIPSTVKNVTRPAPNGRPSLGQSPSSLPKFKQLICILTRTKSLRYIIDD

SEQ ID NO: 17 - DNA, 20 bp, Artificial Sequence
  Artificially Synthesized
ttcgcggtggctcacgcctg

SEQ ID NO: 18 - DNA, 25 bp, Artificial Sequence
  Artificially Synthesized
tagtcgggaggctgaggcaggagaa

SEQ ID NO: 19 - DNA, 21 bp, Artificial Sequence
  Artificially Synthesized
tctcttctgcgtgaatgcacc

SEQ ID NO: 20 - DNA, 26 bp, Artificial Sequence
  Artificially Synthesized
aaggctttttaaattttctgagcctg

SEQ ID NO: 21 - DNA, 20 bp, Artificial Sequence
  Artificially Synthesized
tgccacccagaagactgtgg

SEQ ID NO: 22 - DNA, 23 bp, Artificial Sequence
  Artificially Synthesized
accaggaaatgagcttgacaaag

SEQ ID NO: 23 - DNA, 19 bp, Artificial Sequence
  Artificially Synthesized
aggaagaggcctccggttg

SEQ ID NO: 24 - DNA, 19 bp, Artificial Sequence
  Artificially Synthesized
tccgggaaactgtggcgtg

SEQ ID NO: 25 - DNA, 20 bp, Artificial Sequence
  Artificially Synthesized
tcccgttcagctcagggatg

What is claimed:

1. A composition comprising a nucleic acid sequence of a chimpanzee-derived adenovirus vector of serotype AdC6 or AdC7, wherein the early gene E1 is deleted, the ORF3, ORF4, ORF5, ORF6, and ORF7 from the early gene E3 are deleted, and wherein the nucleic acid sequence further comprises a promoter sequence linked to a sequence encoding a heterologous protein, wherein the heterologous protein is at least one HIV protein selected from the group consisting of gp140, gp160 and Gag, wherein the nucleic acid sequence is selected from the group consisting of SEQ ID NOs. 1-8.

2. The composition of claim 1, wherein the promoter is a constitutive promoter.

3. The composition of claim 1, wherein the promoter is a cytomegalovirus immediate early promoter (CMV).

4. A protein expression system comprising the composition of claim 1, wherein the nucleic acid sequence is selected from the group consisting of SEQ ID NOs: 1-8.

5. A protein expression system comprising the composition of claim 1, wherein the nucleic acid sequence encodes an amino acid sequence selected from the group consisting of SEQ ID NOs: 9-16.

6. A method of eliciting an immune response in a mammal against a heterologous protein, the method comprising administering to the mammal a composition comprising a nucleic acid sequence of a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the nucleic acidsequence further comprises a promoter sequence linked to a sequence encoding a heterologous protein, wherein the heterologous protein is at least one HIV protein selected from the group consisting of gp140, gp160 and Gag, wherein the nucleic acid sequence is selected from the group consisting of SEQ ID NOs. 1-8.

7. A method of treating and/or preventing HIV in a mammal, the method comprising:
(a) administering a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the adenovirus vector comprises a promoter sequence linked to a nucleic acid sequence encoding a heterologous protein, wherein the heterologous protein is at least one HIV protein selected from the group consisting of gp140, gp160 and Gag to a mammal in an amount effective to elicit an immune response in the mammal; and
(b) administering to the mammal at a second subsequent time period a second chimpanzee-derived adenovirus vector of serotype AdC6 or AdC7 that differs from the serotype of the adenovirus vector of (a), comprising an early gene E3 wherein the ORF3, ORF4, ORF5, ORF6, and ORF7 are deleted, wherein the early gene E1 is deleted, and wherein the second adenovirus vector comprises a promoter sequence linked to a nucleic acid sequence encoding a heterologous protein, wherein the heterologous protein is at least one HIV protein selected from the group consisting of gp140, gp160 and Gag, wherein T memory cells directed against the heterologous protein are reactivated in the mammal.

8. A method of vaccinating a mammal against HIV infection, the method comprising:
(a) administering a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the adenovirus vector comprises a promoter sequence linked to a nucleic acid sequence encoding a heterologous protein, wherein the heterologous protein is at least one HIV protein selected from the group consisting of gp140, gp160 and Gag to a mammal in an amount effective to elicit an immune response in the mammal; and
(b) administering to the mammal at a second subsequent time period a second chimpanzee-derived adenovirus vector of serotype AdC6 or AdC7 that differs from the serotype of the adenovirus vector of (a), comprising an early gene E3 wherein the ORF3, ORF4, ORF5, ORF6, and ORF7 are deleted, wherein the early gene E1 is deleted, and wherein the second adenovirus vector comprises a promoter sequence linked to a nucleic acid sequence encoding a heterologous protein, wherein the heterologous protein is at least one HIV protein selected from the group consisting of gp140, gp160 and Gag, wherein T memory cells directed against the heterologous protein are reactivated in the mammal.

9. The method of claim 8, wherein the adenovirus vectors are administered prophylactically to the mammal.

10. The method of claim 8, wherein the adenovirus vectors are administered therapeutically to the mammal.

11. The method of claim 8, wherein the adenovirus vectors are administered in combination with an adjuvant.

12. A method of generating an immune response in a mammal, the method comprising the steps of:
(a) administering a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the adenovirus vector comprises a promoter sequence linked to a nucleic acid sequence encoding a heterologous protein, wherein the heterologous protein is at least one HIV protein selected from the group consisting of gp140, gp160 and Gag to a mammal in an amount effective to elicit an immune response in the mammal; and (b) administering to the mammal at a second subsequent time period, a second chimpanzee-derived adenovirus vector of serotype AdC6 or AdC7 that differs from the serotype of the adenovirus vector of (a), comprising an early gene E3 wherein the ORF3, ORF4, ORF5, ORF6, and ORF7 are deleted, wherein the early gene E1 is deleted, and wherein the second adenovirus vector comprises a promoter sequence linked to a nucleic acid sequence encoding a heterologous protein, wherein the heterologous protein is at least one HIV protein selected from the group consisting of gp140, gp160 and Gag, wherein T memory cells directed against the heterologous protein are reactivated in the mammal.

13. The method of claim 12, wherein the adenovirus vector of serotype AdC6 and the adenovirus vector of serotype AdC7 comprise a same or a different HIV heterologous protein selected from the group consisting of gp140, gp160 and Gag.

14. The method of claim 7, wherein the mammal is a human.

15. The method of claim 7, further comprising (c) administering to the mammal a heterologous protein selected from the group consisting of gp140, gp145, gp160, and Gag.

16. The method of claim 12, further comprising (c) administering to the mammal a heterologous protein selected from the group consisting of gp140, gp145, gp160, and Gag.

17. A method of treating and/or preventing HIV in a mammal, the method comprising:
(a) administering a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the adenovirus vector comprises a promoter sequence linked to a nucleic acid sequence encoding a heterologous protein, wherein the heterologous protein is at least one HIV protein selected from the group consisting of gp140, gp160 and Gag to a mammal in an amount effective to elicit an immune response in the mammal; and
(b) administering to the mammal a heterologous protein selected from the group consisting of gp140, gp145, gp160, and Gag at a second, subsequent time period.

18. A method of vaccinating a mammal against HIV infection, the method comprising:
(a) administering a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the adenovirus vector comprises a promoter sequence linked to a nucleic acid sequence encoding a heterologous protein, wherein the heterologous protein is at least one HIV protein selected from the group consisting of gp140, gp160 and Gag to a mammal in an amount effective to elicit an immune response in the mammal; and
(b) administering to the mammal a heterologous protein selected from the group consisting of gp140, gp145, gp160, and Gag at a second, subsequent time period.

19. A method of generating an immune response in a mammal, the method comprising the steps of:
(a) administering a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the adenovirus vector comprises a promoter sequence linked to a nucleic acid sequence encoding a heterologous protein, wherein the heterologous protein is at least one HIV protein selected from the group consisting of gp140, gp160 and Gag to a mammal in an amount effective to elicit an immune response in the mammal; and
(b) administering to the mammal a protein a heterologous protein selected from the group consisting of gp140, gp145, gp160, and Gag at a second, subsequent time period.

20. A method of treating and/or preventing HIV in a mammal, the method of comprising administering to the mammal a therapeutically effective amount of a composition administering to the mammal a theraeutically effective amount of a composition encoded by a nucleic acid sequence selected from the group consisting of SEQ ID NOs: 1-8.

21. A method of vaccinating a mammal against HIV infection, the method comprising administering to the mammal a chimpanzee-derived adenovirus vector of serotype AdC6 or AdC7, comprising an early gene E3 wherein the ORF3, ORF4, ORF5, ORF6, and ORF7 6 are deleted, wherein the early gene E1 is deleted, and wherein the adenovirus vector comprises a promoter sequence linked to a nucleic acid sequence encoding a heterologous protein, wherein the heterologous protein is at least one HIV protein selected from the group consisting of gp140, gp160 and Gag to a mammal in an amount effective to elicit an immune response in the mammal, wherein T memory cells directed against the heterologous protein are reactivated in the mammal, wherein the nucleic acid sequence is selected from the group consisting of SEQ ID NOs 1-8.

22. The method of claim 21, wherein the adenovirus vector is administered prophylactically to the mammal.

23. The method of claim 21, wherein the adenovirus vector is administered therapeutically to the mammal.

24. The method of claim 12, wherein the adenovirus vector is administered in combination with an adjuvant.

25. A method of generating an immune response in a mammal, the method comprising the steps of:
(a) administering a chimpanzee-derived adenovirus vector of serotype AdC6 or AdC7, comprising an early gene E3 wherein the ORF3, ORF4, ORF5, ORF6, and ORF7 are deleted, wherein the early gene E1 is deleted, and wherein the adenovirus vector comprises a promoter sequence linked to a nucleic acid sequence encoding a first heterologous protein, to a mammal in an amount effective to elicit an immune response in the mammal; and
(b) subsequently administering to the mammal a chimpanzee-derived adenovirus vector of serotype AdC6 or AdC7, wherein the early gene E1 is deleted, the ORF3, ORF4, ORF5, ORF6, and ORF7 from the early gene E3 are deleted, and wherein the adenovirus vector comprises a promoter sequence linked to a nucleic acid sequence encoding a second heterologous protein, wherein T memory cells directed against the heterologous protein are reactivated in the mammal, wherein the first heterologous protein and the second heterologous protein are the same heterologous protein or different heterologous proteins and are selected from the group consisting of gp140, gp145, gp160, and Gag.

26. The method of claim 25, wherein the first heterologous protein and the second heterologous protein are the same heterologous protein.

27. The method of claim 25, wherein the first heterologous protein and the second heterologous protein are different heterlogous proteins.

28. The method of claim 20, wherein the mammal is a human.

29. The method of claim 21, wherein the mammal is a human.

30. The method of claim 25, wherein the mammal is a human.

\* \* \* \* \*